United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 18

SEQ ID NO: 19825 - DNA, 4314 bp, Homo sapiens
cgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagcctgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagcgcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaactggaactccataaggaggggccaaattgggaggccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctga

SEQ ID NO: 19826 - DNA, 746 bp, Homo sapiens
gggggcgcgggaggggcctcggccctgccatgccggtctccgcccgcgggggaggagacgggggaggaggaggggagcagccggccggggcgactcggtgaccagccggccggcccagcagaggtggctgcactgcccgtcgccggagatggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttg

SEQ ID NO: 19827 - DNA, 628 bp, Homo sapiens
ggtcaggctggtcttgaattcctgacctcgtgatccacctgtgtcggcctcccaaagtgctgggtttacaggtgtgagccaccgcgcttggctgattgtattttctttagggccttggactttcggcttgattcgggccaaacattttggattgctgcgttaaaactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaac

SEQ ID NO: 19828 - DNA, 3020 bp, Homo sapiens
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcgg

SEQ ID NO: 19829 - DNA, 3079 bp, Homo sapiens
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcgg

SEQ ID NO: 19830 - DNA, 3044 bp, Homo sapiens
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagttttctttcttttgaattgtcaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcgg

SEQ ID NO: 19831 - DNA, 3723 bp, Homo sapiens
atcctcctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggaaaaaaaaaagaaacaacaaaaaaaaaagagagatgggccaattttttgactctttaatagaaacctattttgtggtgccttttgctgtatgctcatctggggctccgggggacaggtctgggttgtggggtgctgagagtgacagctgggagagaagaggtgcgggttctgttgggggcgagggtggggggcggtggggggttggccctaaggaagaactgaggacggaagtagctttgctcccaggcaagagctgaagttcccgacccctgggaggagagggccaggaccctaggcttggagctggagctggggtaacttccagggggagataaagacacagctacccgaatggggaagccctggctactcacagctgttaaaggagggggggcagagaaacgtttccccaagagcctgagcccagggaggtggcagctctgccaggggcccaatgttggcggctcctgtcccccacagcctccaggacgcccctccgtcctctgcagcaccttcgtttacaggtcgtcttttctattttacacctgcatgtcctttgcatttcagattctttagattggatgcatggtcacgctgggaccgagaagagccactcgacagtgtattccccttttagcaataaagtaacaccatttccttctcacaggctgcctcctagcccccaacccacctatgacatccactcgtctccagtcctgccctcccacccccaaaaactgggtccactgctaatttgtcaaaaaggtaattgtttaaaaaaaaaaaaaatcccaaacagaaacagatgggaatcctgtcctgaaatgtctgaacacctgactgttgacacttgaacatttttatattataaataaaatcagaaataactcctgtt

SEQ ID NO: 19832 - DNA, 2613 bp, Homo sapiens
atcctcctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatcagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagtgtcctgtgggatacaccggggacaggtgtcagcagttcgcaatggtcaacttctccaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtcagttcctaccccctgacctattccccgcttagccagagggctggcaccactggcccaaggctgacccttagggcccctcagaaacactccaaagagcctcatctccatttttcatatgggaaaacaaggtcctagaaaaggtgaaatggcctgctcagagccatcggcatgttaatgacagactgggactagagttgggccagtggaccctggtggacagtgaccatctaatttaattgtcctcccaggacacttttcacactagaaaaaggacattattaatagttacactggaacatcaagaacaaacaggcagccgggcgcggtggctcacacctgtaatcccagcacttgggaggccaaggcggatggatcacctgaggtcaggagtttgagactagtctggccaacatggtgaaacccccatctttactaaaaatacaaaaattagccaggcatggtggcacatgcctgtaatcacagctacttgggaggctgaggcaagagcatcccttcacctgggaggcggaggttgcagtgagctgagatggcgccactgcactccaacctcagcaacagagcaagactccctttac

SEQ ID NO: 19833 - DNA, 3026 bp, Homo sapiens
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccacaagactagggggagatgtagaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcgg

SEQ ID NO: 19834 - DNA, 2535 bp, Homo sapiens
atgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctag

SEQ ID NO: 19835 - DNA, 2923 bp, Homo sapiens
cggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggaaaaaaaaaagaaacaacaaaaaaaa

SEQ ID NO: 19836 - DNA, 2158 bp, Homo sapiens
gggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaa

SEQ ID NO: 19837 - DNA, 3136 bp, Homo sapiens
caggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacgatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggatagaggtcaggaagactatatcccacctgcctatacagctgtggtgtgttgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgt

SEQ ID NO: 19838 - DNA, 2163 bp, Homo sapiens
atgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggatagaggtcaggaagactatatcccacctgcctatacagctgtggtgtgttgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 19839 - DNA, 2088 bp, Homo sapiens
atgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacccatataggaattatattcacagagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 19840 - DNA, 1174 bp, Homo sapiens
actgtagcagacagtgtctccaggcagggtactgagcaaagaggatagtgaaaagggcagtgaaacatcggcctttttcactggcaacttcaagactcactgcctacaatcagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtga

SEQ ID NO: 19841 - DNA, 1491 bp, Homo sapiens
actgtagcagacagtgtctccaggcagggtactgagcaaagaggatagtgaaaagggcagtgaaacatcggcctttttcactggcaacttcaagactcactgcctacaatagacggggtttcaccgtgttaaccaggatggtctcaatttcctgacctcgtgatccgcctacctcggcctcccaaagtgctgggattacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaattattcaaaggtggaaaggcatcctgtgactgcattggagaaaatgatggagtcaagttttgtcggcccccagtcattccctgaggtcccttctcctgacagaggaagccagtctgtcaaacaccacaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatcc

SEQ ID NO: 19842 - DNA, 506 bp, Homo sapiens
gagctgggcagggggcggaggcgggggctcggctgtctccggggctgccacgcagagcgggcttcgtggcgtggactaaaagtgaatcagaaaaataaagaaccagcatcaaatttgaagtggccacaaattctattaaagcagaagaaatagtggtgaaccataaaagagaaccagtttcctctctattctgcaatttagaggaaaaattttcatccaaggacagatcaggtggtggacctagatgggaaacccaaattataatcaagagatttcttggtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtagtctacacgaaaatgaaaatgacaacaatgaagacctttatgatgatctacttccacttaatgaatag

SEQ ID NO: 19843 - DNA, 1159 bp, Homo sapiens
acactgcagccatataaatcagatttttgacatgttataaaatgcaagtcacagctgctgttgtctgcggtattcaaaaacttttgaaacactgcatgtccaacaaaatttattttttgtgtgaatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggaaaggccactttcagagagccagttcagtccagtatgatatcaacctggtagagacgagcagtaccagtgcccaccacagtcatgaacaacactgaagaaacgtcaaagtgaaccaaatcattgtttttattttacaaaggcagaaaatgaaacaccactaggtaaaagaattaaaaatctaatcctttatttcttaaataaaacgcttgtgtaactcgtatcatgaaccataatccattctgctgcaaggtgtgtgtgcttctgtaatgtgcatcagtccatcggcaactgctaagtagggggtgataccagtataattcgaagtcacattggttcaacatgactctccccagaaagctgatgtgctgaagcaaccagaggcaaatgttcacacacctagagagaaaccctaagggatatatgaagatcttatgaaaaaggatgaaaaccctttaaatgcaaggagtagctggcttagtggcttcaaaaccacctcattcctgctgttatctgagaagctgcaagtactgatgaaaaaactgagaagacatttcacctggcaattagaaaaaagcgctgactgatagatacctctgtatcattctttcaatattgatgaaaatgctttctactagaagtgactgatttcaaggatctgtctctcaaaggaagaaacaaaaacccaaaattttgactgcaaaagattgactaattctaggtgcaa

SEQ ID NO: 19844 - DNA, 388 bp, Homo sapiens
tttctgtttaggtcagaagtgttctttatagaacagaactgggagcttgtaatcataatgtactgtttttcaaccctactctcttgaccaagaatgaaactatttacaaattaagatgccaacagatcacgaagagccctgtggtcccagtcacaagtcgttttgcctgaatggggggctttgttatgtgatacctactattcccagcccattttgtaggtgcgttgaaaactatacaggagctcgttgtgaagaggtttttctcccaggctccagcatccaaactaaaagtaacctgtttgaagcttttgtggcattggcggtcctagtaacacttatcattggagccttctacttcctttgcaggtgtggtaacacatgcatgtag

SEQ ID NO: 19845 - DNA, 1047 bp, Homo sapiens
ggacccgcctttgctcggcggagacagcaggcagagagtttctctctagggaaaaggacgcagttggtgtggagcagggcatcggtggtcctgtcaggaagagtggcgcgggtgccgatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattc

SEQ ID NO: 19846 - DNA, 2088 bp, Homo sapiens
gcggccgccgtctgcagagccaggccctgaggcgggccggcgccccctcccccgccccgaactgcggcgcaggcgcgaaccggacccgcctttgctcggcggagacagcaggcagagagatgaggaaactgagacccagaaaggtggaagcacttgtctaaggtcacgcctccaggaagcagtgtgtccacgactccagtccaagtggtcaggctccagagcccacagtcccaggggtccatgatgccgagctgcaatcgttcctgcagctgcagccgcggccccagcgtggaggatggcaagtggtatggggtccgctcctacctgcacctcttctatgaggactgtgcaggcactgctctcagcgacgaccctgagggacctccggtcctgtgcccccgccggccctggccctcactgtgttggaagatcagcctgtcctcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgataggctggctgagccaggacaccaaggcagagcccttggaccccgaagccgacagccacgtggaggtcttcggggatgagccagagcagcagttgtcacccattttccgcaatgccagtggccagtcatggttctcgccacccgccagcccctttgggcaatcttctgtgcagactatccagcccaagagggactcctgagctgcccacatggcctaagatgtgggtcctggatccttccccccttctcaccataaccccctctcagtgtttccccaacttctcccttttagcagggtccctttagagcccaactccaggtcaaatctggagctcaaatcccagtgctccctccccaggagtggggccccaactcttccaagataccagcattcctcaagtcctcccaaaacttcctacccacaccctcttcccaaggccctcaggggcagaaaacatctccttcaacccgtccccactccttcctctgcatgaccttgggcaaacccttgccctttcaagccatcagctcctgcctctctgccatgagggctttggatcagattcctcttctcgccaggatgaggacacgcactgccctccatagacacagatgaaggggtgggggtcattcagctcgaatgggtcccagatgctcacttggcctttccctgcaggatgagtgaagacgtttgcctctcacagtgtgtcttctacctgcattttggcatcagagccccccagcccacccaccacaggcaattactagccctagttgataggtgaggtgggtgaagaaggctggaggtgacatgtccgaggtcacacaacaaagcagcatgcaggaactagaaacacatcttcagcctcctcctgggccagctcttgtgctacaggtggggcggagccagcccctcaccttcctggttccctgagggtcctcagggtggaggacaggtttggcccagaaagactagccagaggcctgatggtcccaggtggctctggatatactttggatatggatttaaatggtctctaagagccgggggtagggggcaggaaaagtgggttgtctttgcccctcaaagtccacctacctagaaaccaagcccacggtcttggccgtgaccctgataataaatgggctctctcagaggcgccagcccctccctccccagccggaggcgtcatctctcttctgtaccactagagggagctctgatgcagctggagagcagcgctcaaggctctcgcccctcccctccctaacccttaccttcagtctccaccagcctgaagggcctcctaggggatcctcaggcggcccccaccagggcacaccctactgtccttgtgcctcacgccccctcctcatcctgcaccccttccatcccaccttccctttcaataaacagctgggatggatactga

SEQ ID NO: 19847 - DNA, 5573 bp, Homo sapiens
ttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcggcggcggcggcggcggcggcgcaggggggcgcctggccctgctttggatagtcccgctcaccctcagcggcctcctaggagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatcaca

SEQ ID NO: 19848 - DNA, 5816 bp, Homo sapiens
cctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctc

SEQ ID NO: 19849 - DNA, 3157 bp, Homo sapiens
gatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagttgcattgatgaaagctgacttgcaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctg

SEQ ID NO: 19850 - DNA, 4500 bp, Homo sapiens
atggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagctgatactaacttagagggtctggcgcacctgatgatgggcgaccaagcaaagtcaaaaagaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctga

SEQ ID NO: 19851 - DNA, 7578 bp, Homo sapiens
gcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctg

SEQ ID NO: 19852 - DNA, 7505 bp, Homo sapiens
ctctctctctctctctctctctctctttctttctttccgatggggaagagagggtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttctcctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctg

SEQ ID NO: 19853 - DNA, 4434 bp, Homo sapiens
atggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagctgatactaacttagagggtctggcgcacctgatgatgggcgaccaagcaaagtcaaaaagaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctga

SEQ ID NO: 19854 - DNA, 4647 bp, Homo sapiens
atggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaagaaggacaatgactttgaaggtctggcgcacctgatgatgggcgaccaagcaaagtcaaaaagaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcaggaaacaatgataacgagcgcctggcgattgctagacagcgaattccatatcgacttggtcgagtagttgatgaatggctactcgacaaagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctga

SEQ ID NO: 19855 - DNA, 4627 bp, Homo sapiens
gccctggaaatctgggagcagccacccgctccgcgcttgctgttcccggggctgcctttccggacaagcccctctccagctgcattctacaggtcaccggcatccttgcgaggcggacacgctgggacgacatatatctttagcaaaggtggtggacaaatcacgtataagtggcctcctaatgaccgacccagtacacgagcagacagactggccataggttttagcactgttcagaaagaagccgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctggatttcagacatacagcaccttagaaatatgtataattcatagcaaatcaccactatctatggttgccaagtaattgttgtgtacaaagaaatttagtggctttttatgacccagaaagtagaaggtataaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaactgtgatttattgattttaaaaattatatgcggcaccatttcgtgcttaagtgggaaagtaaagaaggctgcatttgaagggaagacccatccttatattatagaggaagaatgttgactctcttttttctggatttaactagtcattaaagacctctatattcatacacttaaagatgtagccattaaatgtacttttgttatatttgttcatcttgatatgccagaaaccataaactcatacagtattagttgcaaacaatattaaaatactaatttcataaatatgctttttctctataaaagacaatggaatccaagttaagtaaacctgtgattaaattccaacactatc

SEQ ID NO: 19856 - DNA, 6621 bp, Homo sapiens
tgcagggatgcggcggcgggagcagccgccctgactcgcggagcatcctcctcggagaggcaccgcggcggggcgggcgggcgggcggggacgcggcggggagggagagaggcgcgaggcggcagacaccgctagccctggctctgccacccgtcggagacggggcggccctgtagctctgctacccaccctccagcttctggcgccccgagaaccaggcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattcc

SEQ ID NO: 19857 - DNA, 6411 bp, Homo sapiens
tgcagggatgcggcggcgggagcagccgccctgactcgcggagcatcctcctcggagaggcaccgcggcggggcgggcgggcgggcggggacgcggcggggagggagagaggcgcgaggcggcagacaccgctagccctggctctgccacccgtcggagacggggcggccctgtagctctgctacccaccctccagcttctggcgccccgagaaccaggcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagctccttcccctttccaaggtccggctcacctgacgttaaacagcgaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcggtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattcc

SEQ ID NO: 19858 - DNA, 6373 bp, Homo sapiens
ggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 19859 - DNA, 6413 bp, Homo sapiens
tgcagggatgcggcggcgggagcagccgccctgactcgcggagcatcctcctcggagaggcaccgcggcggggcgggcgggcgggcggggacgcggcggggagggagagaggcgcgaggcggcagacaccgctagccctggctctgccacccgtcggagacggggcggccctgtagctctgctacccaccctccagcttctggcgccccgagaaccaggcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcggtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 19860 - DNA, 6381 bp, Homo sapiens
gcatccctccctgctcttctgtcggagcccgcggcgggggaggggcgccgccgccgccgcctgagggaagccggcatctgggcctctgcgcgcctcgccccgcggccgggcccatggcactgtgagcctgcaagggagccccgctcagcgcggggagcgcccggccccctcccgccccatgcgcccgcggctctgaagcctgagcgggggccgggggccgggcggggccggggccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggcctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccatcgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattc

SEQ ID NO: 19861 - DNA, 3535 bp, Homo sapiens
ggcagcagcggcgcggccggccccagtcgccgtcggtctcccgccttcgggggaaccaggtctccgtccctcttctctcctccagcccgcaccgccccgctccccagctcggtttttccgcaggatttccctcgctctcccctccctgcttggcccccgcgctcccctccctctccactcggcaccatgccccctcccccgggcgctcccccgggtttctgacggccctctgcgccgctccgaccccgccgggatgcagagagacccctagctcctcgcgatggacccaggcatcctggaccttggcgttgccgctccgcggacccccgatttcccggcgggatccagttgattttgttggctccggaccgaggcttgggccctggtttacctccgcttcatccctaccccgctcccggagctcggagccggaggggggcttcgcggggctgcgcagccccgcgtccccgcccccggccatggggctgtgaggcggtcgcccccgggccgaaatgccccccggggggagcgggccgggggggtgcccgcgccgccccccggccctggctgggcccctgccgccgcctccaccgccgccgccgccacctctgctgccgctgttgccgctgttgctgctgttgctgctgggggcggccgagggggcccgggtctcctccagcctcagcaccacccaccacgtccaccacttccacagcaagcacggcaccgtgcccatcgccatcaaccgcatgcccttcctcacccgcggcggccacgccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaa

SEQ ID NO: 19862 - DNA, 4633 bp, Homo sapiens
acttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaaaa

SEQ ID NO: 19863 - DNA, 4932 bp, Homo sapiens
atgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggaagctcgggggacccctgcctctcccacctcatgatgagtgaacaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacctagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaagaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaa

SEQ ID NO: 19864 - DNA, 4179 bp, Homo sapiens
atgagctccacactccactcggttttcttcaccctgaaggtcagcatcctgctggggtccctgctggggctctgcctgggccttgagttcatgggcctccccaaccagtgggcccgctacctccgctgggatgccagcacacgcagtgacctgagtttccagttcaagaccaacgtctctacggggctgctcctctacctggatgatggcggcgtctgcgacttcctatgcctctccctggtggatggccgcgttcagctccgcttcagcatggactgtgccgagactgccgtgctgtccaacaagcaggtgaatgacagcagctggcacttcctcatggtgagccgtgaccgcctgcgcacggtgctgatgcttgatggcgagggccagtctggggagctgcagccccagcggccctacatggatgtggtcagtgacttgttccttggtggagtccctactgacatacgaccttctgccctgacccttgatggagttcaggccatgcccggcttcaaggggttaattctggatctcaagtatggaaactcggagcctcggcttctggggagccggggtgtccagatggatgccgagggaccctgtggtgagcgtccctgtgaaaatggtgggatctgctttctcctggacggccaccccacctgtgactgttctaccactggctatggtggcaagctctgctcagaaggcctctcccacctcatgatgagtgaacaaggtaggtggaaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggtaggtcagccagaagctctaatgcagctagatcactccgtgccgcccttacatggacatggcgactcacttacacatttactcctatcatcttcatctcctgtgtagttcactcatag

SEQ ID NO: 19865 - DNA, 3649 bp, Homo sapiens
ttcttcagtgcccagttttctgccgtgggatggtgttaggcccgggaagaacagagcctaaatgcacccctctacccacttccaccgggatcttgacgaagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaa

SEQ ID NO: 19866 - DNA, 4219 bp, Homo sapiens
ctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggcaacactgataatgaacgcttccaaatggtaaaacagaaaatccccttcaaatataatcggcctgtagaggagtggctgcaggaaaaaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 19867 - DNA, 4156 bp, Homo sapiens
caggactggagggcttgaggaatgtggtggtccctctcttcgttgtttctgccccctgaggttgtgctttctcagggatatgcactctgcacttccattcctgcagtgaaattaactcgagcttggcagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaagggaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttagactgtatcaggataaactgtaactccagcaaaggaccagagaccttgtatgcagggcagaagctcaatgacaacgagtggcacaccgttcgggtggtgcggagaggaaaaagccttaagttaaccgtggatgatgatgtggctgagggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggacccagtaccacctgccaggaagattcatgtgccaaccagggggtctgcatgcaacaatgggagggcttcacctgtgattgttctatgacctcttattctggaaaccagtgcaatgatcctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaa

SEQ ID NO: 19868 - DNA, 3381 bp, Homo sapiens
atatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacgctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcagccaacatcagatgatcttgtttcatctgctgaatgttcaagtgatgatgaagactttgttgaatgtgagccgagtacaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaac

SEQ ID NO: 19869 - DNA, 1624 bp, Homo sapiens
ccccctcagcctctctctctctctctctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaactctgcggcagcggcaacggggcggcggggtccctgctcccggcgttcccggtgctcctggtgtctctctcggcagctttagcgacctggctttccttctgagcgtggggccagctccccccgcgcgcccacccacactcactccatgctcccggaaatcgagaggaagatccattagttctttggggacgttgtgattctctgtgatgctgaaaacactcatataggattgtgggaaatcctgattctcttttttatttcgtttgatttcttgtgttttatttgccaaatgttaccaatcagtgagcaagcaagcacagccaaaatcggacctcagctttagtccgtcttcacacacaaataagaaaacggcaaacccaccccattttttaattttattattattaattttttttgttggcaaaagaatctcaggaacggccctgggccacctactatattaatcatgctagtaacatgaaaaatgatgggctcctcctaataggaaggcgaggagaggagaaggccaggggaatgaattcaagagagatgtccacggacgaaacatacggtgaataattcacgctcacgtcgttcttccacagtatcttgttttgatcatttccactgcacatttctcctcaagaaaagcgaaaggacagactgttggctttgtgtttggaggataggagggagagagggaaggggctgaggaaatctctggggtaagagtaaaggcttccagaagacatgctgctatggtcactgaggggttagctttatctgctgttgttgatgcatccgtccaagttcactgcctttattttccctcctccctcttgttttagctgttacacacacagtaatacctgaatatccaacggtatagatcacaagggggggatgttaaatgttaatctaaaatatagctaaaaaaagattttgacataaaagagccttgattttaaaaaaaaaagagagagagatgtaatttaaaaagtttattataaattaaattcagcaaaaaaagatttgctacaaagtatagagaagtataaaataaaagttattgtttgaaa

SEQ ID NO: 19870 - DNA, 10791 bp, Homo sapiens
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtaaaacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19871 - DNA, 3794 bp, Homo sapiens
attcgaaagaaaaatccaacttatgaattgtcattaatgcaaaattatttatcagaaaatcgtagagcactggaaccccatcatttcacagatgagaagaccagaagcaaaatgacctgccagagttgcagactgacaactgctgccttggcctagtcaagcccagacaggcatctcctactgccttaatttgggggcatctttctaggaccctgatctgcctccacatcttgaaggattttcaagatagccatgtttcacaaaggaacgagggcagctgtgtttagagtggtcaaatttctgattctgtttttttgcttaggaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19872 - DNA, 10783 bp, Homo sapiens
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattca

SEQ ID NO: 19873 - DNA, 11119 bp, Homo sapiens
aggcagggggcggcaacatggcggagtgagcggcggcgtcggggcttcacaacaacagtggtggccgtagcagcggcggcagcagcgtcaatagcatcggccacagcctgagcttcagcaccggccagcgtcgtggccagctgctcgcgtcctcgggcttctcggagcggctgcagcatctccgcggggggcgggccgggccggacagaccgggagagggagagagcagaggcagcggcggcggcagcggcagcggcagcggcacacctgctgggcgggcacagccgcttgcccggcagcggttagcggtaccgccaccgccgagaataagcctgcggatcccccgccgcctccgcgggggagagcgccggagcgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactggttctaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19874 - DNA, 10857 bp, Homo sapiens
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtactaagacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggagattccagaagcttatttcattagagacccccacactttccttcttacaaaggactttattaaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19875 - DNA, 10692 bp, Homo sapiens
gcggcgtcggggcttcacaacaacagtggtggccgtagcagcggccgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgagtgtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19876 - DNA, 2888 bp, Homo sapiens
aatcgccactgggctcgtcacgacagcctccttcagctccaacccggctaattaatccccactcatggatataggcacacaaactaaaggttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactc

SEQ ID NO: 19877 - DNA, 11119 bp, Homo sapiens
aggcagggggcggcaacatggcggagtgagcggcggcgtcggggcttcacaacaacagtggtggccgtagcagcggcggcagcagcgtcaatagcatcggccacagcctgagcttcagcaccggccagcgtcgtggccagctgctcgcgtcctcgggcttctcggagcggctgcagcatctccgcggggggcgggccgggccggacagaccgggagagggagagagcagaggcagcggcggcggcagcggcagcggcagcggcacacctgctgggcgggcacagccgcttgcccggcagcggttagcggtaccgccaccgccgagaataagcctgcggatcccccgccgcctccgcgggggagagcgccggagcgggccgggctgaggcgcaggcggggagcgggcccggcgccgcggcgctggtggatgctggggctccgaggcgacggccggggggcgggggccgaggcaggtataacggtaccggcggcggcagcgccgctgctcttcccttctcctcaggaggggggccaatggctagcgagaagccgggcccgggcccggggctcgagcctcagcccgtggggctcattgccgtcggggccgctggcggaggcggcgggggcagcggtggtggcggcaccgggggcagcgggatgggggagctaaggggggcgtccggctccggctcggtgatgctccccgcggggatgattaacccttcggtgccgatccgcaacatccggatgaaattcgcagtgttgattggactcatacaggtcggagaggtcagcaacagggacatcgtggagacggtgctcaacctgctggttggtggagaatttgacttggagatgaactttattatccaggatgctgagagtataacatgtatgacagagcttttggagcactgtgatgtaacatgtcaagcagaaatatggagcatgtttacagccattctacgaaaaagtgttcggaatttacagactagcacagaagttgggctaattgaacaagtattgctgaaaatgagtgctgtagatgacatgatagcagatcttctagttgatatgttgggggttcttgccagctacagcatcactgtcaaggagttgaagcttttgttcagcatgcttcgaggagaaagtggaatctggccaagacatgcagtaaaattattatcagttcttaatcagatgccacagagacacggtcctgatacttttttcaatttccctggttgtagcgctgcggcaattgccttgcctcctattgcaaagtggccttatcagaatggcttcaccttaaacacttggtttcgtatggatccattaaataatattaatgttgataaggataaaccttatctttattgttttcgtactagcaaaggagttggttactctgctcattttgttggcaactgtttaatagtcacatcattgaagtccaaaggaaaaggttttcagcattgtgtgaaatatgattttcaaccacgcaagtggtacatgatcagcattgtccacatttacaatcgatggaggaacagtgaaattcggtgttatgttaatggacaactggtatcttatggtgatatggcttggcatgttaacacaaatgatagctatgacaagtgctttcttggatcatcagaaactgctgatgcaaatagggtattctgtggtcaacttggtgccgtgtatgtgttcagtgaagcactcaacccagcacagatatttgcaattcatcagttaggacctggatataagagtaccttcaagtttaaatctgagagtgatattcatttggcagaacatcataaacaggtgttatatgatgggaaacttgcaagtagcattgcctttacatataatgctaaggccactgatgctcagctctgcctggaatcatcaccaaaagagaatgcatcaatttttgtgcattccccacatgctctaatgcttcaggatgtgaaagcgatagtaacacattcaattcatagtgcaattcattcaattggagggattcaagtgctttttccactttttgcccaattggataataggcagctcaatgacagtcaagtggaaacaactgtctgtgctactctgttggcattcctggttgaactacttaaaagttcagtagccatgcaagaacagatgctgggtggaaaaggctttttagtcattggctacttacttgaaaagtcatcaagagttcatataactagagctgtcctggagcaatttttatcttttgcaaaataccttgatggtttatctcatggagcacctttgctgaagcagctttgtgatcacattttatttaacccagccatctggatacatacacctgcaaaggttcagctttccctatacacatatttgtctgctgaatttattggaactgctaccatctacaccaccatacgcagagtaggaacagtattacagctaatgcacaccttaaaatattactactgggttattaatcctgctgacagtagtggcattacacctaaaggattagatggtccccggccatcacaaaaagaaattatatcactgagggcatttatgctactttttctgaaacagctgatactaaaggatcgaggggtcaaggaagatgaacttcagagtatattaaattacctacttacgatgcatgaggatgaaaatattcatgatgtgctacagttactggtggctttaatgtcggaacacccagcctcaatgataccagcatttgatcaaagaaatggaataagggtgatctacaaattattggcttctaaaagtgaaagtatttgggttcaagctttgaaggttctgggatactttctgaagcatttaggtcacaagagaaaagttgaaattatgcacacccatagtcttttcactcttcttggagaaaggctgatgttgcatacaaacactgtgactgtcaccacatacaacacactttatgagatcttgacagaacaagtatgtactcaggtcgtacacaaaccacatccagagccagattctacagtgaaaattcagaatccaatgattcttaaagtggtggcaactttgttaaaaaactctacaccaagtgcagagctgatggaagttcgtcgtttatttttatctgatatgataaaacttttcagtaacagccgtgaaaatagaagatgcttattgcagtgttcagtgtggcaggattggatgttttctcttggctatatcaatcctaaaaattctgaggaacagaagattaccgaaatggtctacaatatcttccggattcttttgtatcatgcaataaaatatgaatggggaggctggagagtctgggtggataccctctcaatagcccattccaaggtcacttatgaagctcataaggaatacctagccaaaatgtatgaggaatatcaaagacaagaggaggaaaacattaaaaagggaaagaaagggaatgtgagcaccatctctggtctttcatcacagacaacaggagcaaaaggtggaatggaaattcgagagatagaagatctttcacaaagccagagcccagaaagtgagaccgattaccctgtcagcacagatactcgagacttactcatgtcaacaaaagtgtcagatgatattcttggaaattcagatagaccaggaagtggtgtacatgtggaagtacatgatcttttagtagatataaaagcagagaaagtggaagcaacagaagtaaagctcgatgatatggatttatcaccggagactttagtaggtggagagaatggtgcccttgtggaggttgaatctctgttggataatgtatatagtgctgctgttgagaaactccagaacaatgtacatggaagtgttggtatcattaaaaaaaatgaagaaaaggataatggtccattgataacattagcagatgagaaagaagaccttcccaatagtagtacatcatttctctttgataaaatacccaaacaggaggaaaaactacttcctgaactttctagcaatcacattattccaaatattcaggacacacaagtacatcttggtgttagtgatgatcttggattgcttgctcacatgaccggtagcgtagacttaacttgtacatccagtataatagaagaaaaagaattcaaaatccatacaacttcagatggaatgagcagtatttctgaaagagacttagcgtcatcaactaaggggctggagtatgctgaaatgactgctacaactctggaaactgagtcttctagtagcaaaattgtaccaaatattgatgcaggaagtataatttcagatactgaaaggtctgacgatggcaaagaatcaggaaaagaaatccgaaaaatccaaacaactactacgacacaagctgtgcagggtcggtctatcacccaacaagaccgagatctccgagttgatttaggatttcgaggaatgccaatgactgaggaacagcgacgccagtttagcccaggtccacggactacaatgtttcgtattcctgagtttaaatggtctccaatgcaccagcggcttctcactgatttactatttgcattagaaactgatgtacatgtttggaggagccattctacaaagtctgtaatggattttgtcaatagcaatgaaaatattatttttgtacataacacaattcacctcatttcccaaatggtagacaacatcatcattgcttgtggaggaattttacctttgctctctgctgctacatcaccaactgtaagtaaaacggaattggaaaatattgaagtgacacaaggcatgtcagctgagacagcagtaactttcctcagccggctgatggctatggttgatgtacttgtgtttgcaagctctctaaattttagtgagattgaagctgagaaaaacatgtcttctggaggtttaatgcgacagtgcctaagattagtttgttgtgttgctgtgagaaactgtttagaatgtcggcaaagacagagagacaggggaaataaatcttcccatggaagcagtaaacctcaggaagttcctcaaagtgtgactgctacagcagcttcgaagactccattggaaaatgttccaggtaacctttctcctattaaggatccggatagacttcttcaggatgttgatatcaatcgccttcgtgctgttgtctttcgggatgtggatgatagcaaacaagcacagttcttagctctggctgttgtttacttcatttcggttctgatggtttccaagtatcgtgacatattagaaccccagagagagactacaagaactggaagccaaccaggtagaaacatcaggcaagaaataaattcaccaacaagtacagttgtggtcataccatctatccctcatccaagtttgaaccatggattccttgccaagttaattcctgagcagagctttggccactcattttacaaagaaacacctgctgcatttccagacaccataaaagaaaaagaaacaccaactcctggtgaagatattcaggtagaaagttcaattccccatacagattcaggaattggagaggagcaagtggctagcatcctgaatggggcagaattagaaacaagtacaggccctgatgccatgagtgaactcttatccactttgtcatccgaagtgaagaaatcacaagagagcttaactgaaaatcctagtgaaacgttgaagcctgcaacatccatatctagcattagtcaaaccaaaggcatcaatgtgaaggaaatactgaaaagtcttgtggctgctccagttgaaatagcagaatgtggccctgaacctatcccatacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatctcgtacacttcttggcagtcatggacaagagctattgatagaaggccttgtttgtatgaagtccagcacatctgtggttgagcttgttatgctgctttgttctcaggaatggcaaaactctattcagaagaatgcaggacttgcatttattgagctcatcaatgaaggaagattactgtgccatgctatgaaggaccatatagtccgtgttgcaaatgaagctgagtttattttgaacagacaaagagccgaggatgtacataaacatgcagagtttgagtcacagtgtgcccaatatgctgctgatagaagagaggaagaaaagatgtgtgaccatcttatcagtgctgctaaacatcgagatcatgtaacagcaaatcagctgaaacagaagattctcaatattctcacaaataaacatggtgcttggggagcagtttctcatagccaattgcatgatttctggcgtttggattactgggaagatgatcttcgtcgaaggagacgatttgttcgcaatgcatttggctccactcatgctgaagcattgctgaaagctgcaatagaatatggcacggaagaagatgtagtaaagtcaaagaaaacattcagaagtcaagcaatagtgaaccaaaatgcagagacagaacttatgctggaaggagacgatgatgcagtcagtctgctacaggagaaagaaattgacaaccttgcaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaatggatccattaatagccaataattcaggtgtaaacaaacggcagatcacagacctcgttgaccagagtatacaaatcaatgcacattgttttgtggtaacagcagataatcgctatattcttatctgtggattctgggataagagcttcagagtttattctacagaaacagggaaattgactcagattgtatttggccattgggatgtggtcacttgcttggccaggtccgagtcatacattggtggggactgctacatcgtgtccggatctcgagatgccaccctgctgctctggtactggagtgggcggcaccatatcataggagacaaccctaacagcagtgactatccggcaccaagagccgtcctcacaggccatgaccatgaagttgtctgtgtttctgtctgtgcagaacttgggcttgttatcagtggtgctaaagagggcccttgccttgtccacaccatcactggagatttgctgagagcccttgaaggaccagaaaactgcttattcccacgcttgatatctgtctccagcgaaggccactgtatcatatactatgaacgagggcgattcagtaatttcagcattaatgggaaacttttggctcaaatggagatcaatgattcaacacgggccattctcctgagcagtgacggccagaacctggtcaccggaggggacaatggggtagtagaggtctggcaggcctgtgacttcaagcaactgtacatttaccctggatgtgatgctggcattagagcaatggacttgtcccatgaccagaggactctgatcactggcatggcttctggtagcattgtagcttttaatatagattttaatcggtggcattatgagcatcagaacagatactgaagataaaggaagaaccaaaagccaagttaaagctgagagcacaagtgctgcatggaaaggcaatatctctggtggaaaaaactcgtctacatcgacctccgtttgtacattccatcacacccagcaatagctgtacattgtagtcagcaaccattttactttgtgtgttttttcacgactgaacaccagctgctatcaagcaagcttatatcatgtaaattatatgaattaggagatgttttggtaattatttcatatattgttgtttattgagaaaaggttgtaggatgtgtcacaagagacttttgacaattctgaggaaccttgtgtccagttgttacaaagtttaagctttgaacctaacctgcatcccatttccagcctcttttcaagctgagaaaaaaaaaaaaaaacacgtttgatactttgtacatcagatgcatcttatttaaaagggatacttttgtaaaagtaaaaccttgtataaagaacaaaatgtttcttaattttattgtggagttacaacttgcatgttccttactcctgttggcttgatggaacaggtgcattcacactatgaaacagaaagatctgtccaaggacacagcttgtatgaaagggttgaatttgggctccatcagtaatttttgacattttcaccaaaatatagtttgcactttttaatctaaagtcatcccttctgagtgaaatttgctcataaagcatttggatactaagccattatttgccattttgggtactttatacaaagaaaattcagccctaccctgcataatttgaagacacagcagaaagggggcttagggatgaggtcctggtttttcttgtataaataggagtcatgggcgttagttctgtagtaataacttcccagcacctggacatctcttccagagttatcccactggcttggtgtgtatacattaggggaggataatctgatgctaactttttttttctctttggttcttgaatagcttagtttctttaataacaagtcaaactttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcggtagggctatgaggcatgttacaggaatgtaattttctcagaatttacactcactcgcagtcatttatttaaaaagataaaacaagataatgggttctttgtattggcactttgcaccagaaacatatcattatttattgatgtgattacttatttgttatccaccttgtactagtaagttttagcactgaattccttcttcactgttgtttgtatttatgaaattctgaaattatggggaatcagcgtaatgattaagttattcatcaccaggctgtaagcaatatcttgagtttgtagcttagaattgggaggatacttaacatctggaagacaagttcatttcatcttgagatcatggtgaaatattttggatatataaattccttaagctattgtaaccatgttttattgcaaagatgtaaaatatgccagatgtgtgtgagttggaaatcaaaaaaagaaaaataaaatatgcaaagaattc

SEQ ID NO: 19878 - DNA, 1560 bp, Homo sapiens
aggattgcgaagaatggctccctttggggagactttacagaaaacatttaggcccagtggttctcagcacccctgcccagctcatcgctcccgtggtggtggccaaggggactctctccatcaccacgacagaaatctacttcgaggtagatgaggatgattctgccttcaagaagatcgacacgaaagttcttgcatacactgagggacttcacggaaaatggatgttcagcgagatacgagctgtattttcaagacgttaccttctacaaaacactgctttggaagtatttatggcaaaccgaacctcagttatgtttaatttccctgatcaagcaacagtaaaaaaagttgtctatagcttgcctcgggttggagtagggaccagctatggtctgccacaagccaggaggatatcattggccactcctcgacagctttataaatcttccaatatgactcagcgctggcaaagaagggaaatttcaaacttcgaatatttgatgttccttaatactattgcaggacggacatataatgatctgaaccaatatccagtgtttccgtgggtgttaaccaactatgaatcagaagagttggacctgactcttccaggaaacttcagggatctatcaaagccaattggtgctttgaaccccaagagagctgtgttttatgcagagcgttatgagacatgggaagatgatcaaagcccaccctaccattataatacccattattcaacagcaacatctactttatcctggcttgttcgaattgaacctttcacaaccttcttcctcaatgcaaatgatggaaaatttgatcatccagatcgaaccttctcatccgttgcaaggtcttggagaactagtcagagagatacttctgatgtaaaggaactaattccagagttctactacctaccagagatgtttgtcaacagtaatggatataatcttggagtcagagaagatgaagtagtggtaaatgatgttgatcttcccccttgggcaaaaaacctgaagactttgtgcggatcaacaggatggccctagaaagtgaatttgtttcttgccaacttcatcagtggatcgaccttatatttggctataagcagcgaggaccagaagcagttcgtgctctgaatgtttttcactacttgacttatgaaggctctgtgaacctggatagtatcactgatcctgtgctcagggaggccatggaggcacagatacagaactttggacagacgccatctcagttgcttattgagccacatccgcctcggagctctgccatgcacctgtgtttccttccacagagtccgctcatgtttaaagatcagatgcaacaggatgtgataatggtgctgaagtttccttcaaattctccagtaacccatgtggcagccaacactctgccccacttgaccatccccgcagtggtgacagtgacttgcagccgactctttgcagtgaatagatggcacaacacagtaggcctcagaggagctccaggatactccttggatcaagcccaccatcttcccattgaaat

SEQ ID NO: 19879 - DNA, 8788 bp, Homo sapiens
gctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcagaaatctatcaaatgtggaagaaattgggacttgctcgtacattaattatgtcatcaccatgacaacactctatattcagcaattaaaaagcaaaaaaaaagagaaggaaatggcagatcagacatgtattgaagaatttgtgatccacgcattggcattttgtgaaagcttatatgatccatatcggaattggagacatagaatttcaggacgaatccttagtactgtggaaaagagcagacagaaatataaaccagcttctctcacagtggaattcgtccctttcttttatcaatgttttcaggaaagtgaacatctcaaggaaagtcttaaatgttgcttattgcatctctttggagccattgtagccggtgggcagaggaatgctttgcaagcaatttctccagccactatggaagttcttatgcgagtattggcagattgtgattcctgggaggatggagatcctgaagaagtgggtaggaaggcagaactaactctgaagtgccttacagaagtggtacatatccttctcagtagcaactctgatcagcgtcaagtggaaaccagtactattctggagaactattttaaattgctaaattcagatcattcagctttacctaatcaaaggaggtccagacagtgggaaaaccgatttattgctctacagatcaaaatgctgaataccatcacagccatgttagattgtacagatagacctgttcttcaggccatttttcttaacagcaattgctttgaacatctcatacgactgctacagaactgcaaggtgtttcagggacaattggattgtttggccatatcaaccattcaggctttgaccgcagtaatgaacaaatctccagctgctaaggaagtatttaaagaaagaattggttatacacatatgcttgaagtattaaaatccctgggtcagccaccactggaattacttaaagaacttatgaatatggctgtagagggtgaccacacttcagttgggattttgggcattagtaatgtccaacctctcttgcttcttatccagtggcttccagaactacaatcccatgacctgcaaatcttcatctctgattggctgaaaagaatttgttgtattaatagacagagtcgaactacttgtgtcaatgcaaacatggggattagaatcattgaaacccttgacttgcattcttccctccatcaaacttgtgctgagaacttgattgcaatccatggttccttggggagtcagtcagtgagctcagaagaaatccgtcgactactgagattgctgagagtggatgaatctgagtctgttcacccttatgtcactcccgtgactcgagcaatcctgacaatggcccgaaaactaagtctagagagtgccctccagtatttcaatttgtcacatagtatggcaggaatttctgtgcctcccatacagaaatggccagggtctgccttttctttcagtgcttggttttgcttagaccaggatcagttgactcttggcattgctaacaaaggagggaaaaggaaacaattgtacagtttttttacaggaagtggcatgggttttgaagcctttattacccattcaggtatgttggtcgtggcagtgtgcacaaaaagagaatatgcaacggttatgcttcctgaccacagtttctgtgattccctctggcacaacataactgttgtccacatgcctggaaaaaggccttttggtcagagcttcgtctatatctatgacaatggacaacagaaggtttctgcccctctcagatttcctgccatgaatgaaccctttacttcctgttgcattggttcagctgggcaaagaaccaccactcctccaccatcccaaatcccagatccacctttctcttctcccattacccctcatcggacatcatttggtggaattctgtcatcagcctcctggggaggaacaattgaaaaatcaaaattgattaccaaattgatatcagctggaacccaagacagtgaatgggggtgtcccacatctctggagggtcagctaggatctgttatcatcttttatgaaccactacaacctcctcaggtgaaggcattatatttagcaggtccaaattgtttaagcccttggaagtgtcaagagtctgacatggccgacctgcctggtaacatccttctttactacacagcaaaggcctgcaaaaattcaatctgtcttgatttatctactaattgtttgcatggaagattaacaggaaacaaagtagtgaactgggacattaaggatatcataaactgcataggtgggttaaatgtactctttcctttattggaacaaatcagccactttagtgaaggacagattcctgaagaaaagaatgaaagcacagttcctgaatcagtaacacctgttgaaggagattggctcgtatggacttccacaaaggcctcagagtcaagactagagagaaacctagttgcaacatttatcttaattgtgaaacattttattcagagacatcctatcaaccagggcaatcttattcactcccatggagttgcaactcttggtgctttacttcagaaggtgccaagcaccttgatggatgttaatgtgttgatggcagttcagttactaattgaacaagtatcattagagaaaaatatgcagctcctgcaacaaatgtatcaatatttactctttgactttcgtatttggaaccgtggagattttccctttcgaatcggtcacatacagtatctttcaaccatcattaaagacagcaggagagttttccgaaagaagtatggtgtgcagtttctcctagatacacttaggatttattatgggaatggttgtaaatataatgaactatctctagatgatattcgaacaataaggacttctttgtatggactaattaaatattttctgtgcaaaggtggatctcatgaagagatacaaagtattatggggtacatagctgctactaatgaagaagaacagctctttggaattttggacgtgctcttcagtctcctacgtaccagcccaaccagaggtcagcttttcttactgctttttgaaccaggaaatgctgacatactgtacgcattgctcttaaatcagaagtactctgacagactaagagaaatcatttttaagattatggaacaaatgttgaaatgcacgaacgtttatgagcgtagtaaacaacatattcgactcagagaagttggctactcgggactgggactccttcttaatgaagcacttgttaatacttctcttattaaaaacctcacccatcaaatcataaatacagatcctgttattaatttcaaagatctactatctgtggtatatatatctcacagagcacatataaatgttagagtggccatctgcagaaaggttttgcaaattttgcagttccagccagatgcagcacatcaaatatcacagcaagtgggttggcaagacaccttagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaactttgctacaaaagatgttagaatgggcaatctcagaaaacagagaagcaaaaactaatccagtaactgctgaaaacgccttccgactagtgctgatcatacaggactttcttcagtcagagggactagttaattcaaacatgtggaccgagaagcttttagaggatatgatgctgctctttgactgtctgtcagtctgctattctgaaagtccagtatgggtaaaactctctcaaattcagatccagttgcttctaggattcattggaaggggtaatttgcaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatatattgtaccttatatgaagcagtatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaaggaaacagaatccaattcactggaagctagctaatgtagagaattattcccgcatgagacttaagctggtaccgaattataatttcaaaacccatgaggaagctagtgccttgagagataatctgggtatccaacactcacagccttccagtgatacattgcttttggaagtagtgaaacaagtaaaagttagtgatatggtggaggataaattagaccttcctgaagaggatataacagctagagtaaatgttgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagaggttagaaacaaaatatatagccgactgttgtcacttcattccccaaatagttattatggaagcagatcaccacaggagttattcaaagcatcaggattgacacagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaaggtttgactgtgcagatcgacagttccattctattcctgctacctggcaagctcttatggataatccatatgatgttaaagaacttattcctgaattcttctatttcccagagtttttggaaaatcaaaatcaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaagataacaataagcatgaattatgttattggaacccatggatggttgccttatgacagaaacatttctaattactttacattcatcaaggatcaaactgtgacaaatccaaaaactcagcgcagtataaatggttcttttgctcccgggctagagatcacttctaagctatttgtagtatcacatgatgcaaagttgctcttcagtgctggatactgggataatagcattcaagtgatgtcacttacaaaaggcaaaattatctcacacatcatccggcatatggatattgtgacttgcttagctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaaggcttttatccctgaaaatcatttacagataaccacaatttgctgtggtatataaactaattcttggtctatactaagatgtatttgagaaaatacatttgatttgattttgtggcccattcctaaaggtcattgtatccatttttaaaacaaactaaaatgagaacattaggttcaattttcttattattccaaatgataaaatttaagatttttctaataaaagagtacagataatgggacagttgagagagatggctttaaatacattcttaagtaatcattttcctatttactgaccactgtaatgaaaatatatcaatttatttatggaactcctgattggggataatattttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactag

SEQ ID NO: 19880 - DNA, 10938 bp, Homo sapiens
gctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcagaaatctatcaaatgtggaagaaattgggacttgctcgtacattaattatgtcatcaccatgacaacactctatattcagcaattaaaaagcaaaaaaaaagagaaggaaatggcagatcagacatgtattgaagaatttgtgatccacgcattggcattttgtgaaagcttatatgatccatatcggaattggagacatagaatttcaggacgaatccttagtactgtggaaaagagcagacagaaatataaaccagcttctctcacagtggaattcgtccctttcttttatcaatgttttcaggaaagtgaacatctcaaggaaagtcttaaatgttgcttattgcatctctttggagccattgtagccggtgggcagaggaatgctttgcaagcaatttctccagccactatggaagttcttatgcgagtattggcagattgtgattcctgggaggatggagatcctgaagaagtgggtaggaaggcagaactaactctgaagtgccttacagaagtggtacatatccttctcagtagcaactctgatcagcgtcaagtggaaaccagtactattctggagaactattttaaattgctaaattcagatcattcagctttacctaatcaaaggaggtccagacagtgggaaaaccgatttattgctctacagatcaaaatgctgaataccatcacagccatgttagattgtacagatagacctgttcttcaggccatttttcttaacagcaattgctttgaacatctcatacgactgctacagaactgcaaggtgtttcagggacaattggattgtttggccatatcaaccattcaggctttgaccgcagtaatgaacaaatctccagctgctaaggaagtatttaaagaaagaattggttatacacatatgcttgaagtattaaaatccctgggtcagccaccactggaattacttaaagaacttatgaatatggctgtagagggtgaccacacttcagttgggattttgggcattagtaatgtccaacctctcttgcttcttatccagtggcttccagaactacaatcccatgacctgcaaatcttcatctctgattggctgaaaagaatttgttgtattaatagacagagtcgaactacttgtgtcaatgcaaacatggggattagaatcattgaaacccttgacttgcattcttccctccatcaaacttgtgctgagaacttgattgcaatccatggttccttggggagtcagtcagtgagctcagaagaaatccgtcgactactgagattgctgagagtggatgaatctgagtctgttcacccttatgtcactcccgtgactcgagcaatcctgacaatggcccgaaaactaagtctagagagtgccctccagtatttcaatttgtcacatagtatggcaggaatttctgtgcctcccatacagaaatggccagggtctgccttttctttcagtgcttggttttgcttagaccaggatcagttgactcttggcattgctaacaaaggagggaaaaggaaacaattgtacagtttttttacaggaagtggcatgggttttgaagcctttattacccattcaggtatgttggtcgtggcagtgtgcacaaaaagagaatatgcaacggttatgcttcctgaccacagtttctgtgattccctctggcacaacataactgttgtccacatgcctggaaaaaggccttttggtcagagcttcgtctatatctatgacaatggacaacagaaggtttctgcccctctcagatttcctgccatgaatgaaccctttacttcctgttgcattggttcagctgggcaaagaaccaccactcctccaccatcccaaatcccagatccacctttctcttctcccattacccctcatcggacatcatttggtggaattctgtcatcagcctcctggggaggaacaattgaaaaatcaaaattgattaccaaattgatatcagctggaacccaagacagtgaatgggggtgtcccacatctctggagggtcagctaggatctgttatcatcttttatgaaccactacaacctcctcaggtgaaggcattatatttagcaggtccaaattgtttaagcccttggaagtgtcaagagtctgacatggccgacctgcctggtaacatccttctttactacacagcaaaggcctgcaaaaattcaatctgtcttgatttatctactaattgtttgcatggaagattaacaggaaacaaagtagtgaactgggacattaaggatatcataaactgcataggtgggttaaatgtactctttcctttattggaacaaatcagccactttagtgaaggacagattcctgaagaaaagaatgaaagcacagttcctgaatcagtaacacctgttgaaggagattggctcgtatggacttccacaaaggcctcagagtcaagactagagagaaacctagttgcaacatttatcttaattgtgaaacattttattcagagacatcctatcaaccagggcaatcttattcactcccatggagttgcaactcttggtgctttacttcagaaggtgccaagcaccttgatggatgttaatgtgttgatggcagttcagttactaattgaacaagtatcattagagaaaaatatgcagctcctgcaacaaatgtatcaatatttactctttgactttcgtatttggaaccgtggagattttccctttcgaatcggtcacatacagtatctttcaaccatcattaaagacagcaggagagttttccgaaagaagtatggtgtgcagtttctcctagatacacttaggatttattatgggaatggttgtaaatataatgaactatctctagatgatattcgaacaataaggacttctttgtatggactaattaaatattttctgtgcaaaggtggatctcatgaagagatacaaagtattatggggtacatagctgctactaatgaagaagaacagctctttggaattttggacgtgctcttcagtctcctacgtaccagcccaaccagaggtcagcttttcttactgctttttgaaccaggaaatgctgacatactgtacgcattgctcttaaatcagaagtactctgacagactaagagaaatcatttttaagattatggaacaaatgttgaaatgcacgaacgtttatgagcgtagtaaacaacatattcgactcagagaagttggctactcgggactgggactccttcttaatgaagcacttgttaatacttctcttattaaaaacctcacccatcaaatcataaatacagatcctgttattaatttcaaagatctactatctgtggtatatatatctcacagagcacatataaatgttagagtggccatctgcagaaaggttttgcaaattttgcagttccagccagatgcagcacatcaaatatcacagcaagtgggttggcaagacaccttagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagagagatgtgaggaggagcttcttcaattactgacacatattttgaattatgtaatgtgtaagggactagaaaagtctgatgatgatacttggattgaacgaggacaagtgttttcagcactaagtaaaccaggaatatccagtgaactacttcgaccatcagatgaaataaaactaactttgctacaaaagatgttagaatgggcaatctcagaaaacagagaagcaaaaactaatccagtaactgctgaaaacgccttccgactagtgctgatcatacaggactttcttcagtcagagggactagttaattcaaacatgtggaccgagaagcttttagaggatatgatgctgctctttgactgtctgtcagtctgctattctgaaagtccagtatgggtaaaactctctcaaattcagatccagttgcttctaggattcattggaaggggtaatttgcaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatatattgtaccttatatgaagcagtatgaagctcatacattttacgatggtcatgagaacatggcactttattggaaggattgttatgaagctttaatggtaaatatgcataaacgagaccgggaaggaggggaaagcaagctcaaatttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaaggaaacagaatccaattcactggaagctagctaatgtagagaattattcccgcatgagacttaagctggtaccgaattataatttcaaaacccatgaggaagctagtgccttgagagataatctgggtatccaacactcacagccttccagtgatacattgcttttggaagtagtgaaacaagtaaaagttagtgatatggtggaggataaattagaccttcctgaagaggatataacagctagagtaaatgttgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggagtaggctttgatttcaagtggcctcattctcaaattcgagagattcatctccggcgttacaatttaagaagatcagcccttgagatttttcatgttgaccaatccaactactttctcaatttcaaaaaagaggttagaaacaaaatatatagccgactgttgtcacttcattccccaaatagttattatggaagcagatcaccacaggagttattcaaagcatcaggattgacacagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaaagctatgagagaaaaatatgaaaattttgaggatcctatgggaactattgataagtttcactatggtactcactattcaaattctgcgggggtcatgcactatctcattcgtgtagaaccgttcaccaccctccacatccaacttcagagtggaaggtttgactgtgcagatcgacagttccattctattcctgctacctggcaagctcttatggataatccatatgatgttaaagaacttattcctgaattcttctatttcccagagtttttggaaaatcaaaatcaatttaacttgggtcgtctacagatttccaaagaattagtaaatgatgtcattctcccgaaatgggctaaatcagctgaagatttcatctataaacataggaaagctttggagtctgaatatgtttcagctcatcttcatgaatggatagatctgatctttggctataaacagaggggaccagctgcagtagaggcactcaacgttttctattattgtagttatgaaggagctgtggatctggatgccttaacagatgagaaagaaagaaaagccttagaagggatgattaataattttgggcaaacaccctgtcaattattaaaggaaccacaccctccaagattatcagcagaagaagcagtgcagaagccaaccaaaatagacacttcaaccctaaacctgtttcaacaccttcctgaactcaagtcattttttatagaggggattagtgatggtattccactattaaaggccaccatccccaaaaatcagtatcgttcttttatgtctcaaggcagccctgagttactgataacaataagcatgaattatgttattggaacccatggatggttgccttatgacagaaacatttctaattactttacattcatcaaggatcaaactgtgacaaatccaaaaactcagcgcagtataaatggttcttttgctcccgggctagagatcacttctaagctatttgtagtatcacatgatgcaaagttgctcttcagtgctggatactgggataatagcattcaagtgatgtcacttacaaaaggcaaaattatctcacacatcatccggcatatggatattgtgacttgcttagctacagattactgtggaatacatttgatttctggttccagagatactacatgtatgatatggcaaataacacaacagggaggtgttcctgtgggcttagcatctaaaccttttcagattctttatggacacaccaacgaggtactgagtgtcggcatcagcactgagctagacatggcagtgtcaggatcaagggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaaggataagaatgcattacatctgttttctataaatggcaagtatctagggtctcaaatcctgaaggaacaagtatcagatatatgtataatcggagaacacattgtcacaggcagcatacaaggattcctgtctataagagatctccacagcttgaatctcagcatcaacccattagccatgcgactgcctatccattgtgtttgtgtcaccaaagaatacagccatattcttgtaggtttagaagatggcaaattgattgtagtgggtgttggcaagcctgctgagatgcgttcaggtcagctttctcgaaaattttggggatcgagcaagcggctcagccagatttcagctggagaaactgaatataatactcaagattccaagtgattgttatttccattttctgttatgattactgaaacctgatttattgctttgtcactttaaccacatctctcaactctctgcaatgttgcaaggcttttatccctgaaaatcatttacagataaccacaatttgctgtggtatataaactaattcttggtctatactaagatgtatttgagaaaatacatttgatttgattttgtggcccattcctaaaggtcattgtatccatttttaaaacaaactaaaatgagaacattaggttcaattttcttattattccaaatgataaaatttaagatttttctaataaaagagtacagataatgggacagttgagagagatggctttaaatacattcttaagtaatcattttcctatttactgaccactgtaatgaaaatatatcaatttatttatggaactcctgattggggataatattttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactagagatacattttacagatgtatttccttaataatataattaagcaaaagtgctaattgtgattttgacagttgggccttttaagtagcatttgcagcacaatttgcatttgcaaagttccgaatttcttgactctttcttcactaagcaaatactgttttactctaataattaagagttagtagtacccaaatatgttgaatttttacttaggatatctgtgtgattgatgaatgaattgaaaagatatgtataacttaaaataatcatttatatatagtaatttaaaaatttctatttcatgttttaggattatagctaattttattatatagtgttaaatgttgtggttgattattaagatcttaaagtaaaagtctgatttatttaatttggaattcaaagacattgttaaacttagatttttttgtaagattatcttttgagttaggtcagagagcttttacaactaccagtgttattaatctgagatttcatgtgtttgggagaacttgtgaatccctctgaaattgtgcagagactttgtatgttaaatgcattttcaggaaggaatggttacatggctttctttaaagggatctgtttccagtaatagtattcttttttgttccacaaatcatagatgtccttaaatccaattgtcttctcagttgaatcttagagaaatttttcttttgcaatttcgctttcctgttgaccacagtatccagtgcccttttctttataatcttttgagtgagtaaaaaaattttaagaaataaaggattctgtttagggaaacttttgaatagatttgatttgatgtgagtcagggctaataaaaagctatagaagaattttctttccaataagtaaaaatcctctgttttattaaggaaaaaatagctatgttttaggtaaataactctgaaataaactggtacaacaattgtaaaatagaacatatttaaatgtcaaggtgtcttttcttaagacttcaggaatttgtattgaacaaagtctcaagttaagtagcaataattatgatgcataaatgagactggcatctattcatttattttattcttttttggggtgatgggaggtttcaatccagtgcttcacccgtggtgccaccgtggctatctttttttttatcttacagttttttaggagatttcaagtcggcagaactaacatgattgatttttagtttttaaaatactgatttttttagaaactttttctaaatcaaaacctactaagttttattttgttatttatccagagattttgatgtaaaaatgccttcatttttaagattacttaatactggatttgaaaattattttggatgcttataagttttctaaaacttagataattagaaaaaatgcctaagtttatgatgttttactatgctgctttttagatggaagaaataagcagtttttactttatagtacaaataagttttgttcacaataaaatagatatcctacctggactaatactagatgtacaaggtagtggaattatttcttatattgctttttccaaaaagtaaaaaccaaaaatgtgggccgggtgtggtggctcatgcctgtaatcccagcactttgggaggctgaggcaggcgaatcacaaggtcaggagttcaagaccagcctggccaacacagtgaaaccctttctctactaaaaatacaaaaattagccgggcatggtggcacatgcctatagtcccagctacttgagaggctgagcagcgcaggagaatcacttaaacccgggaggtggaggttgcagtgacctgagatcacgctactgcactccagcttgggcaacagagtgagactttgtctcaaagaaaagaaaaaaaa

SEQ ID NO: 19881 - DNA, 8275 bp, Homo sapiens
agcagacttgggtggctctgcgccgcggaggccacagccgcagacttccccagtagtaccgcgccgctccgccccggagtgacgccctccgcccatgggcctggccgagggcaaccggcgggcggcgcggaggaggcggcgacaggtggcgcgcagcagggccggagccgggccgggccatggccgcctcggagcggctgtacgagttgtggctgctctactacgcgcagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaagctgtacctgcagtcccgggcgccccccgagggggacagtgacctggctacccggttactgactgagcccgatgtccaaaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagc

SEQ ID NO: 19882 - DNA, 1901 bp, Homo sapiens
aaagttttcctggcagcgcctagacctgggcttagccactgcccctcttgcccatggaaccagctctggggcctggggtccagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgccccccccaccctgcccagctcagggattggcgggcgatgttaccccctcagggattggcgggcggaagtcccgcccctcgccggctga

SEQ ID NO: 19883 - DNA, 8737 bp, Homo sapiens
agcagacttgggtggctctgcgccgcggaggccacagccgcagacttccccagtagtaccgcgccgctccgccccggagtgacgccctccgcccatgggcctggccgagggcaaccggcgggcggcgcggaggaggcggcgacaggtggcgcgcagcagggccggagccgggccgggccatggccgcctcggagcggctgtacgagttgtggctgctctactacgcgcagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaagctgtacctgcagtcccgggcgccccccgagggggacagtgacctggctacccggttactgactgagcccgatgtccaaaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagc

SEQ ID NO: 19884 - DNA, 2781 bp, Homo sapiens
tggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctgggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgt

SEQ ID NO: 19885 - DNA, 8667 bp, Homo sapiens
gccggagccgggccgggccatggccgcctcggagcggctgtacgagttgtggctgctctactacgcgcagaaggacctgggttacctgcagcagtggctgaaggcctttgtaggtgccttcaagaagagcatctcactgtcctctctggagccacgaaggccagaggaggcaggtgcagaggtcccgctgctaccactggatgagctgcatgtgctggccgaacagctgcaccaggctgacctggagcaagccctcctgctgctcaagctcttcatcattctctgcaggaacctggagaacatagaggcaggccggggccaagtgctagtgccccgagtgctggcactgttgaccaagttggtggcggagctgaaaggatgcccaccaccccagggccgaggcacgcagttggagaatgtggccctacatgctctgcttctctgcgagggcctctttgacccttaccaaacctggcggcgccagcgcagtggggaagtcatcagctccaaggagaagagcaaatacaagttccctcctgctgctttgccccaggaattcagcgccttcttccaagagagcctacagaatgcagaccacttgcctcccatactgctgttacgtctcatccacctcttctgcgccgtcctcgctggaggaaaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcgacgccatccccatgatgctggcatgtgaagaccggccagtgctgcaagccaccttcctcagcaacaattgctttgaacacctcactcggctcattcagaacagcaagctgtacctgcagtcccgggcgccccccgagggggacagtgacctggctacccggttactgactgagcccgatgtccaaaaggtcctggaccaagacacagacgccattgcagtccatgtagtcagagtgctgacctgcatcatgagtgactccccctcggccaaggaggtgtttaaggagcgcatcggctaccctcacctgcaggaggttctgcagagccatggtccccccacccatcggctgttgcaagagctgctcaacatggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacagcttctttaccagcagcggctcagggtttgaggccttcttcacggcggccgggaccctggtggtggctgtgtgcacacggaaggagtatttgaccatgagtttgcccgaagtgtcctttgccgactctgcctggcactgcgtggctatcgtccatgtgcctgggcgccggcccttcagccagaacctggtccatgtctacaaagacggccatctggtcaagacagcaccccttcgctgcccctccctcagtgagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctggggcccaatgagacggcacccttcaagcctgagggggagctgcatgagctcagcaccaggctgctcctccattactcacctcaggcttgtaagaacaacatctgcctggacctgtcccccagtcatgggcttgatgggcgcctgacgggccacagagtggagacctgggatgtgaaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtcacatccagtacatgtccagcatagttcgggagcacagacagaagctgcggaagaagtacggcgtccagtttatcttggatgctctgcgcacccactacagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggcggtgggtgcgctggacctgctgctggccctgctgcacggttccctggtgcaggagtccttggctgtctttctgttggagccagggaacctcgaagtgctactggccctgctagtgcggccagggtcactgcccctgctgcccgatcgagtctgcaagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcagattgcctgaacctctcagatctgctggctgtggtacagctgtccctccaggctgacctcagcgttcgcctagacatctgtcgccagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaagctctttgaaggtgtatgcagcctacttgatcgcctgggagcctggccccacctggccaacggcacagctgatctccgtgagatggcgcagattggcctacggcttgtacttggctacatcctgctggaagacccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgagggacactcccatcccccgctggaaactgtccagcgccgagacatattcacgcatgcgtctgaagctggtgcccaaccatcacttcgaccctcacctggaagccagcgctctccgagacaatctgggtgaggttcccctgacacccaccgaggaggcctcactgcctctggcagtgaccaaagaggccaaagtgagcaccccacccgagttgctgcaggaggaccagctcggcgaggacgagctggctgagctggagaccccgatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccagaaatgggtacagcgtgagatatccaacttcgagtacttgatgcaactcaacaccattgcggggcggacctacaatgacctgtctcagtaccctgtgttcccctgggtcctgcaggactacgtgtccccaaccctggacctcagcaacccagccgtcttccgggacctgtctaagcccatcggtgtggtgaaccccaagcatgcccagctcgtgagggagaagtatgaaagctttgaggacccagcagggaccattgacaagttccactatggcacccactactccaatgcagcaggcgtgatgcactacctcatccgcgtggagcccttcacctccctgcacgtccagctgcaaagtggccgctttgactgctccgaccggcagttccactcggtggcggcagcctggcaggcacgcctggagagccctgccgatgtgaaggagctcatcccggaattcttctactttcctgacttcctggagaaccagaacggttttgacctgggctgtctccagctgaccaacgagaaggtaggcgatgtggtgctacccccgtgggccagctctcctgaggacttcatccagcagcaccgccaggctctggagtcggagtatgtgtctgcacacctacacgagtggatcgacctcatctttggctacaagcagcgggggccagccgccgaggaggccctcaatgtcttctattactgcacctatgagggggctgtagacctggaccatgtgacagatgagcgggaacggaaggctctggagggcattatcagcaactttgggcagactccctgtcagctgctgaaggagccacatccaactcggctctcagctgaggaagcagcccatcgccttgcacgcctggacactaactcacctagcatcttccagcacctggacgaactcaaggcattcttcgcagaggttgtcagtgatggtgtacccctggtgctagccctggtcccccaccggcagccccactccttcatcacccagggttccccagacctgttggtgactgtgagtgccagtgggctgctgggcacccacagctggttgccctatgaccgcaacataagcaactacttcagcttcagcaaagaccccaccatgggcagccacaagacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttgatgtagtaacctgccttgcactggacacctgtggcatctacctcatctcaggctcccgggacaccacgtgcatggtgtggcggctcctgcatcagggtggtctgtcagtaggcctggcaccaaagcctgtgcaggtcctgtatgggcatggggctgcagtgagctgtgtggccatcagcactgaacttgacatggctgtgtctggatctgaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgtagc

SEQ ID NO: 19886 - DNA, 7281 bp, Homo sapiens
ctccgctgcctgagtcctcggcgaacatggcggcccccgagtcagggccggctttgagtccaggcactgcagagggtgaggaggagacgattctctatgacttgttggtcaacaccgagtggccaccggagactgaagtacagcctagaggcaaccaaaaacatggtgcatcctttatcatcacgaaagcaattcgagatcgtttattatttttacgccaatacatctggtacagcccggcaccttttttgctccctgatggactggttcgcttggttaataaacagataaactggcatttggtacttgcaagcaatggaaagcttttggctgctgttcaagatcagtgtgtggaaatcaggtctgcaaaagatgattttacatccattattgggaaatgtcaagttccgaaagacccgaaaccccagtggagacgggtagcatggagttacgattgtaccctactggcctatgccgaaagcacaggaactgtgagggtgtttgatctcatgggaagtgaactctttgtcatttccccggcatctagttttataggtgacttaagctatgccattgctgggttgatatttttagaatataaagcaagtgcacagtggtctgcagaactcctggtcatcaattaccgaggagaacttagaagttaccttgtaagtgttggaacaaatcagagctaccaagaaagtcactgtttcagcttcagtagtcattatcctcatggaatcaacacagctatttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcagccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagagctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttgagtaaaataaagaagcgatcctgggttctccatgagtgtttggaaagagttcctgaaaatgtggatgctgcaaaagaactgcttcagtatggattaaaaggcacagacctggaggctcttttagcaatagggaaaggagcagatgatggcagatttacattacctggtgaaatagacattgacagtatctcctatgaagagctttcaccacctgatgaagagcctgccaagaataaaaaggaaaaggagctcaagaagagacaagaactactgaaattagtgaacttttccaagttgacactggaacaaaaggaactttgccgttgtagacggaagttattaacctacttagatcgacttgcaacatatgaggaaatcctaggagtgcctcatgcatctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcaggtggactgtgcattgtcacttattcgacttgggatggagcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgatgagcaa

SEQ ID NO: 19887 - DNA, 6922 bp, Homo sapiens
ctccgctgcctgagtcctcggcgaacatggcggcccccgagtcagggccggctttgagtccaggcactgcagagggtgaggaggagacgattctctatgacttgttggtcaacaccgagtggccaccggagactgaagtacagcctagaggcaaccaaaaacatggtgcatcctttatcatcacgaaagcaattcgagatcgtttattatttttacgccaatacatctggtacagcccggcaccttttttgctccctgatggactggttcgcttggttaataaacagataaactggcatttggtacttgcaagcaatggaaagcttttggctgctgttcaagatcagtgtgtggaaatcaggtctgcaaaagatgattttacatccattattgggaaatgtcaagttccgaaagacccgaaaccccagtggagacgggtagcatggagttacgattgtaccctactggcctatgccgaaagcacaggaactgtgagggtgtttgatctcatgggaagtgaactctttgtcatttccccggcatctagttttataggtgacttaagctatgccattgctgggttgatatttttagaatataaagcaagtgcacagtggtctgcagaactcctggtcatcaattaccgaggagaacttagaagttaccttgtaagtgttggaacaaatcagagctaccaagaaagtcactgtttcagcttcagtagtcattatcctcatggaatcaacacagctatttaccaccctggtcacagacttttacttgttggtggatgtgaaactgctgaagtaggcatgtcaaaagcttctagctgtggcctttctgcctggagagttctttcaggatcaccgtattataagcaggttactaatggtggagacggggttactgcagtaccgaagacactgggattattaaggatgttaagtgtcaagttttacagtcgccagggacaagaacaggatggaatttttaagatgagcctttctccagatgggatgctcctggcagccattcacttctcagggaaactgagcatctgggcgattccatctctgaagcaacaaggggaatggggtcaaaatgagcagccaggctatgatgaccttaatcctgattggaggctctctactgagaagagaaaaaaaatcaaagataaagagtccttttacccactgatagatgtcaattggtgggcagacagtgcagtgactttagctcgatgctctggtgctttaactgtttcatctgtgaaaactttgaagaatttactgggaaaatcctgtgaatggtttgaaccatcacctcaagtcactgctacccatgatgggggatttttaagtttggagtgtgagattaaacttgcccccaaacgatctcgtttggagactagagctggagaagaagatgaaggagaagaggattctgattctgattatgaaatatctgccaaggctcgctactttggttatataaaacagggcctttacttggtgactgaaatggagcgatttgcaccaccacggaaacgcccacgaaccattactaaaaactaccgccttgtgagtttgcgctccacgacaccagaggaactttatcagaggaagattgaaagtgaagagtatgaggaagccttgtccttggctcatacctacggcctggatactgaccttgtatatcagaggcagtggaggaagtcagcggtcaacgttgcttcaattcagaattatttgagtaaaataaagaagcgatcctgggttctccatgagtgtttggaaagagttcctgaaaatgtggatgctgcaaaagaactgcttcagtatggattaaaaggcacagacctggaggctcttttagcaatagggaaaggagcagatgatggcagatttacattacctggtgaaatagacattgacagtatctcctatgaagagctttcaccacctgatgaagagcctgccaagaataaaaaggaaaaggagctcaagaagagacaagaactactgaaattagtgaacttttccaagttgacactggaacaaaaggaactttgccgttgtagacggaagttattaacctacttagatcgacttgcaacatatgaggaaatcctaggagtgcctcatgcatctgaacagagatatgatgctgaattctttaagaaattcagaaatcagaatattgttctctcagcaagaacttatgctcaggaaagtaatgtacaagccctggaaattctgtttacttaccatggttccgacctgcttcctcatcgccttgcaattctgtccaactttccagagaccacttctccacatgaatattctgttttgctgcccgaagcttgttttaacggtgactccctgatgatcattccttggcatgaacataaacaccgagctaaagattggtgcgaggagttggcttgcagaatggttgttgagccgaatctccaagatgaaagtgaattcttgtatgctgcacagcctgagttactaaggttcaggatgacccagcttacggtggagaaggttatggactggtatcagaccagagcagaggaaatagagcattatgctcggcagctgcagcaaaaaattattcctgatcaggaccaactgatggcaatagcactagagtgcatctatacctgtgaacgaaatgatcaactctgtctttgctatgacctactagaatgtctgccagaaagaggatatggtgataagacagaggcaaccacaaagcttcatgacatggtagaccaactggaacaaattctcagtgtgtcagagcttttggaaaaacatggactcgagaaaccaatttcatttgttaaaaacactcaatctagctcagaagaggcacgcaagctgatggttagattgacgaggcacactggccggaagcagcctcctgtcagtgagtctcattggagaacgttgctgcaagacatgttaactatgcagcagaatgtatacacatgtctagattctgatgcctgctatgagatatttacagaaagccttctgtgctctagtcgccttgaaaacatccacctggctggacagatgatgcactgcagtgcttgttcagaaaatcctccagctggtatagcccataaagggaaaccccactacagggtcagctacgaaaagagtattgacttggttttggctgccagcagagagtacttcaattcttctaccaacctcactgatagctgcatggatctagccaggtgctgcttacaactgataacagacagaccccctgccattcaagaggagctagatcttatccaagccgttggatgtcttgaagaatttggggtaaagatcctgcctttgcaagtgcgattgtgccctgatcggatcagtctcatcaaggagtgtatttcccagtcccccacatgctataaacaatccaccaagcttctgggccttgctgagctgctgagggttgcaggtgagaacccagaagaaaggcggggacaggttctaatccttttagtggagcaggcacttcgcttccatgactacaaagcagccagtatgcattgtcaggagctgatggccacaggttatcctaaaagttgggatgtttgtagccagttaggacaatcagaaggttaccaggacttggccactcgtcaagagctcatggcttttgctttgacacattgccctcctagcagcattgaacttcttttggcagctagcagctctctgcagacagaaattctttatcaaagagtgaatttccagatccatcatgaaggaggggaaaatatcagtgcttcaccattaactagtaaagcagtacaagaggatgaagtaggtgttccaggtagcaattcagctgacctattgcgctggaccactgctaccaccatgaaagtcctttccaacaccacaaccaccaccaaagcggtgctgcaggccgtcagtgatgggcagtggtggaagaagtctttaacttaccttcgaccccttcaggggcaaaaatgtggtggtgcatatcaaatcggaactacagccaatgaagatctagagaaacaagggtgtcatcctttttatgaatctgtcatctcaaatccttttgtcgctgagtctgaagggacctatgacacctatcagcatgttccagtggaaagctttgcagaagtattgctgagaactggaaaattggcagaggctaaaaataaaggagaagtatttccaacaactgaagttctcttgcaactagcaagtgaagccttgccaaatgacatgaccttggctcttgcttaccttcttgccttaccacaagtgttagatgctaaccggtgctttgaaaagcagtccccctctgcattatctctccagctggcagcgtattactatagcctccagatctatgcccgattggccccatgtttcagggacaagtgccatcctctttacagggctgatcccaaagaactaatcaagatggtcaccaggcatgtgactcgacatgagcacgaagcctggcctgaagaccttatttcactgaccaagcagttacactgctacaatgaacgtctcctggatttcactcaggcgcagatccttcagggccttcggaagggtgtggacgtgcagcggtttactgcagatgaccagtataaaagggaaactatccttggtctggcagaaactctagaggaaagcgtctacagcattgctatttctctggcacaacgttacagtgtctcccgctgggaagtttttatgacccatttggagttcctcttcacggacagtggtttgtccacactagaaattgaaaatagagcccaagaccttcatctctttgagactttgaagactgatccagaagcctttcaccagcacatggtcaagtatatttaccctactattggtggctttgatcacgaaaggctgcagtattatttcactcttctggaaaactgtggctgtgcagatttggggaactgtgccattaaaccagaaacccacattcgactgctgaagaagtttaaggttgttgcatcaggtcttaattacaaaaagctgacagatgaaaacatgagtcctcttgaagcattggagccagttctttcaagtcaaaatatcttgtctatttccaaacttgttcccaaaatccctgaaaaggatggacagatgctttccccaagctctctgtacaccatctggttacagaagttgttctggactggagaccctcatctcattaaacaagtcccaggctcttcaccggagtggcttcatgcctatgatgtctgcatgaagtactttgatcgtctccacccaggtgacctcatcactgtggtagatgcagttacattttctccaaaagctgtgaccaagctgtctgtggaagcccgtaaagagatgactagaaaggctattaagacagtcaaacattttattgagaagccaaggaaaagaaactcagaagacgaagctcaagaagctaaggattctaaagttacctatgcagatactttgaatcatctggagaaatcacttgcccacctggaaaccctgagccacagcttcatcctttctctgaagaatagtgagcaggaaacactgcaaaaatacagtcacctctatgatctgtcccgatcagaaaaagagaaacttcatgatgaagctgtggctatttgtttagatggtcagcctctagcaatgattcagcagctgctagaggtggcagttggccctcttgacatctcacccaaggatatagtgcagagtgcaatcatgaaaataatttctgcattgagtggtggcagtgctgaccttggtgggccaagggacccactgaaggtcctggaaggtgttgttgcagcagtccacgccagtgtggacaagggtgaggagctggtttcacctgaggacctgctggagtggctgcggcctttctgtgctgatgacgcctggccggtgcggccccgcattcacgtgctgcagattttggggcaatcatttcacctgactgaggaggacagcaagctcctcgtgttctttagaactgaagccattctcaaagcctcctggccccagagacaggtagacatagctgacattgagaatgaagagaaccgctactgtctattcatggaactcctggaatctagtcaccacgaggctgaatttcagcacttggttttacttttgcaagcttggccacctatgaaaagtgaatatgtcataaccaataatccatgggtgagactagctacagtgatgctaaccagatgtacgatggagaacaaggaaggattggggaatgaagttttgaaaatgtgtcgctctttgtataacaccaagcagatgctgcctgcagagggtgtgaaggagctgtgtctgctgctgcttaaccagtccctcctgcttccatctctgaaacttctcctcgagagccgagatgagcatctgcacgagatggcactggagcaaatcacggcagtcactacggtgaatgattccaattgtgaccaagaacttctttccctgctcctggatgccaagctgctggtgaagtgtgtctccactcccttctatccacgtattgttgaccacctcttggctagcctccagcaagggcgctgggatgcagaggagctgggcagacacctgcgggaggccggccatgaagccgaagccgggtctctccttctggccgtgagggggactcaccaggccttcagaaccttcagtacagccctccgcgcagcacagcactgggtgtgagggccacctgtggccctgctccttagcagaaaaagcatctggagttgaatgctgttcccagaagcaacatgtgtatctgccgattgttctccatggttccaacaaattgcaaataaaactgtatggaaacgatgagcaag

SEQ ID NO: 19888 - DNA, 10697 bp, Homo sapiens
tccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggacgaagaagaggaagaagaccaagacccaccatgccccaggctcagcagggagctgctggaggtagtagcgcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaagactcactggatagatgttattcaactccttcaggttgtcttgaactgactgactcatgccagccctacagaagtgccttttatgtattggagcaacagcgtgttggcatggctgttgacatggatgaaattgaaaagtaccaagaagtggaagaagaccaagacccatcatgccccaggctcagcagggagctgctggatgagaaagagcctgaagtcttgcaggactcactgaatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagacgaagaccaagacccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaccatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctaaagtcttgcaggactcactggatagatgttattcaactccttcaggttgtcttgaactgtgtgactcatgccagccctacagaagtgccttttatgtattggagcaacagcgtgttggcttggctgttgacatggatgaaattgaaaagtaccaagaagtggaagaagaccaagacccatcatgccccaggctcagcagggagctgctggatgagaaagggcctgaagtcttgcaggactcactggatagatgttattcgactccttcaggttgtcttgaactgtgtgactcatgccagccctacagaagtgccttttacatattggagcaacagcgtgttggcttggctgttgacatggatgaaattgaaaagtaccaagaagtggaagaagaccaagacccatcatgccccaggcttagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgtgtgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataa

SEQ ID NO: 19889 - DNA, 1789 bp, Homo sapiens
aaagtgctgtggggagtgatcacatttttcacaacagtaagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggacatcggtgggatcaagtgaaaaaggaggaccaagaggcaacaggtcccaggctcagcagggagctgctggatga

SEQ ID NO: 19890 - DNA, 3715 bp, Homo sapiens
acggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacatccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccagcagggagctgctggatgagaaagggcctgaagtcttccaggactcacaggatagatgttattcaactccttcaggttgtcttgaactgactgactcatgccagccctacagaagtgccttttacatattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggcaacctgtgcgcagtctgaagacaatggacccacattaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatca

SEQ ID NO: 19891 - DNA, 3894 bp, Homo sapiens
aaatgaggtataggggagagaaacacgtactttgaaagaattgacccagctgaattggaaaatgtgggaaggggatggggaagaggctgctccacctgagatctggctccaggacttacagcaaggggaacttggcaacatggccaatctttcctaagctgctcagcttacaagaaaaggaatcatactgctaagaattcaaacttcagcagtcatagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcgtgttggcttcgctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacataggatgggtcagtgggcatggctctattcctattctcaaaccatgccagtggcaacctgtgcgcagtctgaagacaatggacccacattaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctagactcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttcc

SEQ ID NO: 19892 - DNA, 2380 bp, Homo sapiens
cctaaagtgctgtggggagtgatcacatttttcacaacagtaagtccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccagcagggagctgctggatgagaaagggcctgaagtcttccaggactcacaggatagatgttattcaactccttcaggttgtcttgaactgactgactcatgccagccctacagaagtgccttttacatattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggtaa

SEQ ID NO: 19893 - DNA, 2916 bp, Homo sapiens
tgacttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagagtagggtgcctgtgtttcagcaaagcctgggcaattggaatgcagagctcctaagattccatgacacccccaccttctaattctgttattgcaactgcagacggttacctggcacgctggccacattctgcctcactcttatcagagtctgagctactggcagtgctttcagctctgagttgaggcacctcgaaccttgtttttgtggtgaaggatcctaaagtgctgtggggagtgatcacatttttcacaacagtaatccctgactccacctcttctgccacaaacgtcagcatggtggtatcagccggcccttggtccagtgagaaggcagagatgaacattctagaaatcaacgagacattgcgcccccagctggcagagaagaaacagcagttcagaaacctcaaagagaaatgttttctaactcaactggccggcttcctggccaaccgacagaagaaatacagcaatataaagtcctagttcactctcaggaacgagagctgacccagctaagggagaagttacgggaagggagagatgcctcccgctcattgtatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactgtccggcttcctggccaaccaacagaagaaatacaaatatgaagagtgcaaagacctcataaaatttatgctgaggaatgagcgacagttcaaggaggagaagcttgcagagcagctcaagcaagctgaggagctcaggcaatataaagtcctggttcacgctcaggaacgagagctgacccagttaaaggagaagttacgggaagggagagatgcctcccgctcattgaatgagcatctccaggccctcctcactccgtatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcatctgcccccagggagatgcagaaggctgaagaaaaggaagtccctgaggactcactggaggaatgtgccatcacttattcaaatagccatggctcttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaagtggaagaagaccaagacccatcatgccccaggcttagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaaaaaaagaaggggaaga

SEQ ID NO: 19894 - DNA, 531 bp, Homo sapiens
aaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttatgtattggagcaacagcatgttggcttggctgttgacatggatgaaattgaaaagtaccaagaa

SEQ ID NO: 19895 - DNA, 5560 bp, Homo sapiens
ccggaagtcagactatggggcggtgcggcagcgcgaagcctgcagtcctaaacgctgggtagctccgggcttccgagggggtgtgtctcccgcctctttaacctggcaggggcggttcaagtggccggggaaatcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcgggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcttcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 19896 - DNA, 3409 bp, Homo sapiens
attgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaaggaatgtctggacacagtagacaaaggtttttcaacaggatgccttaggatacatgcttccaaaaacaaagtagccaaaaagaaaccagagtcacagaatatcagagccagaggaacatttggagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgc

SEQ ID NO: 19897 - DNA, 578 bp, Homo sapiens
cactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatga

SEQ ID NO: 19898 - DNA, 2618 bp, Homo sapiens
ttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactgtgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctgatggaagtggaagtgcctgaagtcttacaggactcactggatagatattattcgactccatcaatgtactttgaactacctgactcattccagcactacagaagtgtgttttactcatttgaggaacagcacatcagctttgcccttgacatggacaataggttttttactttgacggtgagaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagtcggacattttaatttgaaccacgtatctctgggtagctacaaaattcctcagggatttcattttgcaggcatgtctctgagcttctatacctgctcaaggtcagtgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaactttttgacgggaacactgcagagacaatgctgtgagtttccaacctcagcccatctgcgggcagagaaggtctagtttgtccaacaccattatgatatcaggactggttacttggttaaggaggggtctaggagatctgtcccttttagagacaccttacttataatgaagtacttgggaaagtggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctttgcctgagttttaatttttgtccaaagttaattttaatctatacaattaaaaccttttgcctatc

SEQ ID NO: 19899 - DNA, 2598 bp, Homo sapiens
atggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccatccagcctcacaagaacatcaaaatcacatttgaggaagacaaagtcaactcatctctggttgtagacagagaatcctctcatgatggatgtcaggatgctctaaacattctcccagtccctggccccacctcttctgccacaaacgtcagcatggtggtatcagccggccctttgtccagcgagaaggcagagatgaacattctagaaatcaatgagaaattgtgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagcgacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacatagaaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcagtttatcttggactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccgtgccccaggctcagcagggagctgctggaggtagtagagcctgaagtcttgcaggactcactggatgttattcaactccttccagttgtcttgaacagcctgactcctgccagccctacggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagcgtgctga

SEQ ID NO: 19900 - DNA, 3409 bp, Homo sapiens
attgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaaggaatgtctggacacagtagacaaaggtttttcaactggatgccttaggatacatgcttccaaaaacaaagtagccaaaaagaaaccagagtcacagaatatcagagccagaggaacatttggagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacagcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatactctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgc

SEQ ID NO: 19901 - DNA, 440 bp, Homo sapiens
agcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttt

SEQ ID NO: 19902 - DNA, 271 bp, Homo sapiens
ttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggac

SEQ ID NO: 19903 - DNA, 589 bp, Homo sapiens
aagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttga

SEQ ID NO: 19904 - DNA, 592 bp, Homo sapiens
aaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaag

SEQ ID NO: 19905 - DNA, 12455 bp, Homo sapiens
ggaccctgaggagccagcgggccgcaagcaagttgctgggcggcggttgagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcctcacatggtgtgggccgacatgaagagctgccagatccaacagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatactctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggttggcctcataccagtcttacagcagcacatttcactcattagaggaacagcaagtctgcatggctgttgacataggcagtgagtactccattgtgaaggtgataaagctccagttcatggcccagtctcaggccatgcccgtgccaacctggactgactgtcacgacattgaactcaaggcaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacaaaattgaaaagtaccaagaagtggaagaagaccaagacccatcatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagtaccaagaagtggaagaagaccaagacccatcatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctgcagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacattcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttcca

SEQ ID NO: 19906 - DNA, 618 bp, Homo sapiens
gcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggag

SEQ ID NO: 19907 - DNA, 5560 bp, Homo sapiens
ccggaagtcagactatggggcggtgcggcagcgcgaagcctgcagtcctaaacgcggggtcgctccaggcttccgagggggtgtgtctcccgcctctttaacctggcaggggcggttcaagtggccggggaaatcggcgaattgcagggtcaagggctggtgctttgaaagagaggcggaggggagagagggattttcccgtccccgctgcgctccgtcctccattactccttttctccgcccgcggcccgaacccgttgtgcggtagaggcagccgggtccctttaaggcccagctgcgcctgtgccttgggctctcctgacacggcccatccggaccctgaggagccagcgggccgcaagcaagttgctgggcggcggttgagatagcggcggtgctgggaggggtaggtgagggtcgcgaggctgcctgagcttctgagtgagcctggtgattttgggaacgcgggacgggcgacctgcggcgccaggagcggggccgaggtacggcggcacggctgcagcctggatgggaagttcaagtttactgcgaagtccacccagcgttccggaggtgagggcgccgcgccaggccgggcggcaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcctcacatggtgtgggccgacatgaagagctgccagatccaacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatactctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacattcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataatgtagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatc

SEQ ID NO: 19908 - DNA, 288 bp, Homo sapiens
attgcagaaattgaaaagtaccaagaagtggaagaagaccaagacccatcatgccccaggctcagcagggagctgctggctgagaaagagcctgaagtcttgcaggactcactggatagatggtattcgactccttcaggttatcttgaactgcctgacttaggccagccctacagaagtgctgtttactcattggaggaacagtaccttggcttggctcttgacgtggacaaaattgaaaagtaccaagaagtggaagaagaccaagacccatcatgccccaggtaa

SEQ ID NO: 19909 - DNA, 440 bp, Homo sapiens; identical to SEQ ID NO: 19901

SEQ ID NO: 19910 - DNA, 3689 bp, Homo sapiens
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttgaaaaaaagtaaaaagata

SEQ ID NO: 19911 - DNA, 3671 bp, Homo sapiens
aagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttaacctgagtttcataggaggtaatcaccagacaactgcagaatgtagaacactgagcaggacaactgacctgtctccttcacatagtccatatcaccacaaatcacacaacaaaaaggagaagagatattttcggttg

SEQ ID NO: 19912 - DNA, 1447 bp, Homo sapiens
atcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgt

SEQ ID NO: 19913 - DNA, 1534 bp, Homo sapiens
aatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatc

SEQ ID NO: 19914 - DNA, 1603 bp, Homo sapiens
atcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagcccttactaagccgagaggtgtcattcctgcaggcaggacctataggcacgtgaagatttgaatgaaagtacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatgtcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctc

SEQ ID NO: 19915 - DNA, 1534 bp, Homo sapiens; identical to SEQ ID NO: 19913

SEQ ID NO: 19916 - DNA, 1534 bp, Homo sapiens
aatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatc

SEQ ID NO: 19917 - DNA, 750 bp, Homo sapiens
gaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatggtgagtacctttctatg

SEQ ID NO: 19918 - DNA, 1534 bp, Homo sapiens; identical to SEQ ID NO: 19916

SEQ ID NO: 19919 - DNA, 1534 bp, Homo sapiens; identical to SEQ ID NO: 19916

SEQ ID NO: 19920 - DNA, 1534 bp, Homo sapiens; identical to SEQ ID NO: 19916

SEQ ID NO: 19921 - DNA, 1534 bp, Homo sapiens; identical to SEQ ID NO: 19916

SEQ ID NO: 19922 - DNA, 4020 bp, Homo sapiens
ccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 19923 - DNA, 4707 bp, Homo sapiens
ataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 19924 - DNA, 3640 bp, Homo sapiens
atggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 19925 - DNA, 3830 bp, Homo sapiens
acggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacaaatatgaagagtgcaaagatctcataaaatttatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatgaaattgaaaagtaccaagaagtggaagaagaccaagacccatcatgccccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagatgacaacccaccatgccccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 19926 - DNA, 2604 bp, Homo sapiens
cctaaagtgctgtggggagtgatcacatttttcacaacagtaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaactatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtgcagaaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaa

SEQ ID NO: 19927 - DNA, 15690 bp, Homo sapiens
cagacggttacctggcacgctggccacaatctacctcactcttatcagagtctgagctactggcagtgctttcagctctgagttgaggcaccttgaaccttgtttttgtggtgaaggatcctaaagtgctgtggggagtgatcacatttttcacaacagtaagtccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaactatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtgcagaaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaagacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttcca

SEQ ID NO: 19928 - DNA, 950 bp, Homo sapiens
aaagtgctgtggggagtgatcacatttttcacaacagtaaggtaagaatttcagttactgacatccctcagtcctgattaaacctatttgatttcaccagtttttaacccatcatatgtttgggtttcttctccccagtccctgactccacctcttctgccacaaacgtcagcatggtggtatcagccggcccttggtccagcgagaaggcagagatgaacattctagaaatcaacgagaaattgcgcccccagttggcagagaacaaacagcagttcggaaacctcaaagagagatgttttgtaactcaactggccggcttcctggccaaccagcagaagaaatacaactatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacccagttaagggagaagttacgggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagaaaatgacgaagatgaggatgaagatgttcaagttgaggaggctgagaaagtgcagaaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctccca

SEQ ID NO: 19929 - DNA, 680 bp, Homo sapiens
ctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaccccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacag

SEQ ID NO: 19930 - DNA, 904 bp, Homo sapiens
ctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggag

SEQ ID NO: 19931 - DNA, 617 bp, Homo sapiens
gttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggat

SEQ ID NO: 19932 - DNA, 617 bp, Homo sapiens
gttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggat

SEQ ID NO: 19933 - DNA, 3837 bp, Homo sapiens
gacggttacctggcacgctggccacaatctacctcactcttatcagagtctgagctactggcagtgctttcagctctgagttgaggcaccttgaaccttgtttttgtggtgaaggatcctaaagtgctgtggggagtgatcacatttttcacaacatccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagagatgttttgtaactcaactggccggcttcctggccaaccagcagaagaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctccttactccggatgagccggacaagtcccaggggcaggacctccaagaacagctggctgaggggtgtagactggcacagcaccttgtccaaaagctcagcccagaaaatgacaacgatgacgatgaagatgttcaagttgagttggctgagaaagtgcagaaatcgtctgcccccagggagatgcagaaggctgaagaaaaggaagtccctgaggactcacaggaggaatgtgccatcacttattcaaatagccatggcccttatgactccaaccagccacataggaaaaccaaaatcacatttgaggaagacaaagtcgactcaactctgattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaagacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtt

SEQ ID NO: 19934 - DNA, 471 bp, Homo sapiens
ctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatg

SEQ ID NO: 19935 - DNA, 1485 bp, Homo sapiens
ctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggac

SEQ ID NO: 19936 - DNA, 1447 bp, Homo sapiens
atcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgt

SEQ ID NO: 19937 - DNA, 2606 bp, Homo sapiens
ctctcacattgtcctgttctcatgctgaggagcctgagatccctgtgtggggattagacagtggactgttatgggtgtaggtgaattggcttattttgtctgtccctgtctgaatgtattgcaggaactaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctctcgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagaagttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacgaaggttgaattactcctcctgatattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaactcgctgaacttactttctcctctctctctctctccctctccctgtctttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatg

SEQ ID NO: 19938 - DNA, 2045 bp, Homo sapiens
ctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcaacggcgtgctgatggaagtggaagagcctgaagtcttacaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataaacagcccttactaagccgagagatgtcattcctgcaggcaggacctataggcacgtgaagatttgaatgaaagtacagttccatttggaagcccagacataggatgggtcagtgggcatggctgtattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggttgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcttctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaacgtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaagacattctctgcctgagttttaatttttgtccaaagttaattttaatctatacaattaaaaccttttgcctatc

SEQ ID NO: 19939 - DNA, 617 bp, Homo sapiens; identical to SEQ ID NO: 19931

SEQ ID NO: 19940 - DNA, 1539 bp, Homo sapiens
attttctgtgtcttctaagttcgcttgttttagctcatctgtccatcatgttcctggtatgttttctagataaatggctgacttttcacccacaaaagccataatagctgatgcttctgtgtagaaccaagtttcattttgactcaagagctggtacattgcaccccttcatcaaatctctgtgtccacaatctcataaactatcaaattctgggtatttgatgagagaaagcttaatattgaagtgtctctcctatgaggtgttagaactatttgcctacaatttattggggaaaaaatttctcatttgtgtacagaagcctaggacagagcacatagggaagataacattccaacacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtattggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaactaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatggtgagtacctttctatg

SEQ ID NO: 19941 - DNA, 4401 bp, Homo sapiens
acaggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagggagccttgggaggagcccgaatcactgatggaatcggacagtgcatggagatggttcagcaggacgaggtgctgaaaactcacccctgtgtgacctcaagtaagccacgtaactctgtgaacctgcagttttatcatttttaaaataaagaaacatgacagattttcattatgacacagaatgtcaggtctcccagatgccagaaaatacatttacttaaagccgttgatacgtcttaaagcggtttccttacagtgtcattggaggacagcgtggagtgcagagagacatgctttgaaatgggattgatccagtcctccttccttcactaccacatgaatgctgggcagcccaggatcacactcactgcaccctcaactcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatcactctggactgttggattgttttttacattcagcgttataatcttttgttatgctgattggttttggtgggtactgatgcgaattaataaaaacattttcatttcc

SEQ ID NO: 19942 - DNA, 3765 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatc

SEQ ID NO: 19943 - DNA, 3704 bp, Homo sapiens
gacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccagatcatctggaaggttttgttgtctaatctctgttggttatatcttctgtcatccctgtcctgcctggctcatcaggaatctgcaggagtctgaagaggaggaagccccccaggagtcctgggatgaaggacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatca

SEQ ID NO: 19944 - DNA, 3763 bp, Homo sapiens
caggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagtccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactctgccagtgcagaatatgaacaatgccatgttcttgcagaaaatgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattttggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttcaaagtagaaatgtcctgtattccagtgatcatcctctaaacgttttatcatttattaatcatccctgcctgtgtctattattatattcatatctctacgctggaaatttgctgcctcaatgtttactgtgcctttgtttttgctagtgtgtgttgttgaaaaaaaaacattctctgcctgagttttaatttttgtccaaagttattttaatctatacaattaaaaacttttgcctatc

SEQ ID NO: 19945 - DNA, 2726 bp, Homo sapiens
acaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacaggtggcaagggctctgaaacagccacataaacccttgtagataaggatggtcaaataaaataatattatatctgtaaaaactcagatcttggtaagatttactagttgggaatccagtgttaatgccatgaagcagccgccagttgggatcaaatgtgagcctatggatcaagcaggcccagtgtcttggcaatcatggtgacagtgacattgaaggtgggggctccaccgatgctcttcgtttgaagatgcacggtcagttccccatcctgcagcagtgagtccaggaccacagtacatttctggccccgcagtgtcagcctattcacgaaaaagcttgaccagtctttgccaaccaggacaccaaccttagctggcgtgatgttcacgaaggtttttccctgggacggcggcccagatggaggaaaatataacctgttgggaaactggttctgcctggatggtgttgtacaaacaagcgataaacaatgaggaatgtgcttagatgtattgggaaagagatgggtctgtggcattgtcacaagggtacacgaacactgagagtgaattttagaggaatgatccccattggtggtgaccctcagaccgttacctggcacactggcctcactcttgtcggagactgagctattggcagtgccttcagctctgagctcaggcacctcgaacattgtttttgtcgttaaggatcctaaagtgctgcggggactgatcacatttttctcaacatccctggccccacctcttctgccacaaacgtcagcatggtggtatctgccggcccttggtccggtgagaaggcagagatgaacattctagaaatcaacaagaaatcgcgcccccagctggcagagaacaaacagcagttcagaaacctcaaacagaaatgtcttgtaactcaagtggcctacttcctggccaaccggcaaaataattacgactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaata

SEQ ID NO: 19946 - DNA, 2133 bp, Homo sapiens
ggcgcaggcacaggcgaggggttgggtggcggttgagacagcggcggtactgggatgggtaggtgaggatcccgagactgagtgagcttctgcgcgcggtgcttttgggaacgcgggactggcaacctgcggcgccaggagctgggccgaggcgcggcggcgcggctgcgggccgccgtctggatgggaagttacggcgaagtccacccagcgtttctcaggcaatctgaaggcaaatcctgtttagacccaggcgaaggttcctggtgacccaggctctcaccagccaattgtcccttgccgtcctcctgagggtatctggagcttcagtgctgtgtgctcttggcctccacactggggatgccactgactcccactgtccagggcttccagtggactctccgaggccctgatgtagaaacttccccattcggtgcaccaagagcagcctcacatggtgtgggccgacatcaagagctgcgagatccaacagactatgaagactgcaaagacctcataaaatctatgctgagggatgagcggctgctcacagaagagaagcttgcagaggagctcgggcaagctgaggagctcaggcaatataaagtcctggttcactctcaggaacgagagctgacccagttaagggagaagttacaggaagggagagatgcctcccgctcattgaatcagcatctccaggccctcctcactccggatgagccggacaactcccagggacgggacctccgagaacagctggctgagggatgtaggctggcacagcacctcgtccaaaagctcagcccagaaaatgatgacgatgaggatgaagatgttaaagttgaggaggctgagaaagtacaggaattatatgcccccagggaggtgcagaaggctgaagaaaaggaagtccctgaggactcactggaggagtgtgccatcacttgttcaaatagccaccacccttgtgagtccaaccagccttacgggaacaccagaatcacatttgaggaagaccaagtcgactcaactctcattgactcatcctctcatgatgaatggttggatgctgtatgcattatcccagaaaatgaaagtgatcatgagcaagaggaagaaaaagggccagtgtctcccaggaatctgcaggagtctgaagaggaggaagccccccaggagtcctgggatgaaggtgattggactctctcaattcctcctgacatgtctgcctcataccagtctgacaggagcacctttcactcagtagaggaacagcaagtcggcttggctcttgacataggcagacattggtgtgatcaagtgaaaaaggaggaccaagaggccacaagtcccaggctcagcagggagctgctggatgagaaagagcctgaagtcttgcaggactcactggatagattttattcaactccttttgagtacctggaactgcctgacttatgccagccctacagaagtgacttttactcattgcaggaacaacaccttggcttggctcttgacttggacagaatgaaaaaggaccaagaagaggaagaagaccaaggcccaccatgccccaggctcagcagagagctgccggaggtagtagagcctgaggacttgcaggactcactggatagatggtattcgactcctttcagttatccagaactgcctgattcatgccagccctacggaagttgcttttactcattggaggaagaacacgttggcttttctcttgacgtggatgaaattgaaaagtaccaagaaggggaagaagatcaaaagccaccatgccccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttc

SEQ ID NO: 19947 - DNA, 1917 bp, Homo sapiens
atggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatga

SEQ ID NO: 19948 - DNA, 2499 bp, Homo sapiens
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacttccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaatacctagggagaccaatgcccagatggacaaatagcattgaccggcgttagccctgtttctcaattcccatcgtgtagagaacaggagtccgcagctgctggcaggagacagcatgtcagccgggactctgccagggcagagtatgagcaatgccatgttcttgctg

SEQ ID NO: 19949 - DNA, 2586 bp, Homo sapiens
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacttccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaatacctagggagaccaatgcccagatggacaaatagcattgaccggcgttagccctgtttctcaattcccatcgtgtagagaacaggagtccgcagctgctggcaggagacagcatgtcagccgggactctgccagggcagagtatgagcaatgccatgttcttgctg

SEQ ID NO: 19950 - DNA, 2138 bp, Homo sapiens
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacagttgtttaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 19951 - DNA, 2222 bp, Homo sapiens
cttctaattctgttattgcaactgcagaccgttacctggtacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatga

SEQ ID NO: 19952 - DNA, 2586 bp, Homo sapiens
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccaggaaccgacaatcacttgaaccaggtgaactgaccaacctcagggatttcctgatctcacctgtggtctcccatgtggctaatccaggacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 19953 - DNA, 2499 bp, Homo sapiens
cttctaattctgttattgcaactgcagaccgttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 19954 - DNA, 2494 bp, Homo sapiens
aattctgttattgcaactgcagaccgttacctggtacactggctgctacctccctcactcttgtcagagtcggagctacaggcagtgccttcagctctgagctcaggcatcccggtccctgtttttgcggttaaggactctaaagtgttgtgtcgtgttcatcaactttttctcaacctccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaaagacatcatagactctgtgctgagggatgaactgcagtccatggagaagctggcagagaagctcaggcaagctgaggagctcaggcagtataaagccctggttcactctcaggcaaaagagctgacccagttacgggagaagttacgggaagggagagatgcctcccgctggctgaacaagcatctgaaaaccctcctcactcctgatgaccctgacaagtcccagggtcaggacctccgagagcagctggctgaggggcacaggctggcagagcaccttgttcacaagctgagcccagaaaatgatgaagatgaagatgaggatgaagacgacaaagacgaggaggttgagaaagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccggtcagaggttcaaatttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagtgcagagataccaaatactgctgaaaggatgcaaaggatgataggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaacacctagggagaccaatgcccagatggacaaatagcattgactggcgttagccctgtttctcaattcccatcatgtagagaacaggagtccgcagctgctggcaggagacagcatgtcagccgggactctgccagggcagagtatgagcaatgccatgttcttgctg

SEQ ID NO: 19955 - DNA, 2886 bp, Homo sapiens
agcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacaatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaaggcagatgggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctat

SEQ ID NO: 19956 - DNA, 3347 bp, Homo sapiens
ccagtccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacaatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactgtatagatgttattcaactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatc

SEQ ID NO: 19957 - DNA, 3569 bp, Homo sapiens
tccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacaatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 19958 - DNA, 3568 bp, Homo sapiens
ccagtccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacaagtatgaagagtgtaaagacctcataaaatttatgctgaggaatgagcgacagttcaaggaggagaagcttgcagagcagctgaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacaatgaagatgttcaagttgaggtggctgagaaagtgcagaaatcgtctgcccccagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagaattaaaaaggaccaagaagaggaagaagaccaaggcccaccatgccccaggctcagcagggagctgctggaggtagtagagcctgaagtcttgcaggactcactggatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcagacatgtctctgagcttctatacctgctcaaggtcattgtcatctttgtgtttagctcatccaaaggtgttaccctggtttcaatgaacctaacctcattcttcgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccttatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatc

SEQ ID NO: 19959 - DNA, 3283 bp, Homo sapiens
gtgagaatctggtggatgctggaccttgctgctgctgctactgctgtttccaggggctgcagagcatggactgttaaatcttgcacttcttctgagtgagctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacaga

SEQ ID NO: 19960 - DNA, 3727 bp, Homo sapiens
gacggtgctgtccagggggaggcgggcggagggaaggcgctgccgctgctgccgccgcctcgcccgaagcgacacagacgctgggagcggccgaggcgagatgtatttagactttttaattattcttcctagttcctgataagctaagacaatacttttatttttgacagagtgatttcttctgacttgagcctgcagtgtgctgtgagagatctaccactagattatctcaactttggtctcctgggaccactcgttgctgacagtcagaaattgcaaggcatctgatctcctggtgttaaaatctgtcgtgataccgaggaaggccccgagatcccaggcactgagtgactgcatactctgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 19961 - DNA, 3808 bp, Homo sapiens
aggggccccttagatgtcttcctccggattttttgttaagcttttcctagacagtttacagaaggctttgggtagagaaagcactagttagacaaaagcagcccccctcccaccttgtgggcatgaagagtccagaggacaccacctgagaagcttttcaactgccttccaaggctcccttgaacttcactgcggtagagcagggaccccagaccccccctcaaatcgaagcttggaaggaggtgctctaggctgaatctgacctcccaggacccgaggaggcaagcagatggcaccccttggaaagtagcagtgcaggctggctagaggcctgggcgagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttgaatgcagacttctatttccagaagtgacagcacaagtctgagttgctgtttggtctggtgacctcagacacactaatttgaattgaaagctaagagtaaaaatttgctggttacaggcgagtcatactcttgcaagtagttagcaaagggaggcccaaattctcaaggttgttgatggggaacttgccactaagagaaggcagagaggtccctagtgggtatatttgctgccaagccacttgccaaagaagaggaaccacagaaagagagacatcatgaccaggagaaaaatgtgactagacatgctaacctccaggtttttatatatgacttgagtctgctgtaattggcagcagaaatccaaatttgtatggtagaccaaaaagaaccaaatccatagggtgaaattttgagacctagactctgtaaaaataatcctagtcttcctccaggggtcagttcctcacagtggttctgtaccaaaacttgccaaattcctccatggccaagtgttaaaatctgtgtttggaaaatagcgaattaacctaagacacagaaggcagactgggtgaggagacctagcatgccctattggcagtgctcaggagctgcatcccacttttccctgctctgaatcgaagtcctagttccttcctttgattctcctttggtaggtggaatcagttaatgttttgagaaacctgcctgggctctgcccttagtcatgacatctcgctgagccagacccactctgttccttggaacctagagctggagtgaggagtagaggtctccggctattccagaaagaaaagtgagccacatgcaggctgatgaatgccgacacttccagaatgtatagaaatagtccctgtcctggcctgccactgaccctgtctgtattttctcggaggttgtttttctccttctccttcccaggaaggtctttgtatgtcgaatccagtgcactcaagtttggccaagggactccacagcacccagaagactgcatgcctcaaggtttatgtcactcctctgctgggctgttcattgtcattgctgtgttcagggacctttggaaataaaacctgttctgtcccaaataaaaccagcctgtgatgttcaagggactggaataaagtggcttacgacctgaaggattctacagagtgctcaactgttcatacatcattcagagtgggagggagctgggggtgctgtcccatcccatctgtatgcccacggtggatttaataatatataatttataaatcatagcctatggagtggcccgtaaatcagttgactgtgtagctcttgcctggcattaaagcatgtttttggtttaacatg

SEQ ID NO: 19962 - DNA, 1832 bp, Homo sapiens
aaaaaaaaaaaaaaaaaaaaaaaaaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaaca

SEQ ID NO: 19963 - DNA, 2289 bp, Homo sapiens
gggggaggcgggcggagggaaggcgctgccgctgctgccgccgcctcgcccgaagcgacacagacgctgggagcggccgaggcgagatcctatcattattttaaaattcctcctcctccacgaagtccttcctgattccttcaaagaaatatcactcctccgaattcccagagtgatttcttctgacttgagcctgcagtgtgctgtgagagatctaccactagattatctcaactttggtctcctgggaccactcgttgctgacagtcagaaactgaattcttgccgccaggatggggaaacagaacagcaagctgcgcccggaggtcatgcaggacttgctggaaagcacagactttacagagcatgagatccaggaatggtataaaggcttcttgagagactgccccagtggacatttgtcaatggaagagtttaagaaaatatatgggaactttttcccttatggggatgcttccaaatttgcagagcatgtcttccgcaccttcgatgcaaatggagatgggacaatagactttagagaattcatcatcgccttgagtgtaacttcgagggggaagctggagcagaagctgaaatgggccttcagcatgtacgacctggacggaaatggctatatcagcaaggcagagatgctagagatcgtgcaggcaatctataagatggtttcctctgtaatgaaaatgcctgaagatgagtcaaccccagagaaaagaacagaaaagatcttccgccagatggacaccaatagagacggaaaactctccctggaagagttcatccgaggagccaaaagcgacccgtccattgtgcgcctcctgcagtgcgacccgagcagtgccggccagttctgagccctgcgcccaccaatcgaattgtagagctgcttgtgttcccttttgattcttctttttaacaatttttttttttttttgccaaacaatatcaatggtgatgccgtcccctgtgcggtctgatgcgccttcctccgtgacgccttcagcttcttttgtcgtggatgcttcgtgggaatgcccagagccccagtgtgcttgtggagagcatggacagacttcgtggtgttcattgtttgatgatttttaatcgttactattatttttttttattctaatgtctctgttctaaaacgtaagactcgggggttggggcaaaagaagggaaacccatccagtcctgtgattctattgcaagcttcaaggggcttttgtttgaaagacaaaactccccacctgaatctgttgtcacacgtgccgtaggggtgatggatggcaccggatgctggattccccaagaacaagttaccctctggggtgaggctattccagcgagctgggacatttccccatgggggcccactcccctctcttccccagcaggctgtagtttctaagctgtgaacatttcaagataaattaacagaggagaggaaaaagatggctcagctattttttcacaggtttacactagttgagctaatatgcgtgtctttggaaattaaacacaaatggtaacatattccaaaaccagacccatcttgttgcctattgtgataaaataaaaagacggctgtatataacatattgggtaatgcagaccaaattaagtgttttgccttgtttaaatgaaatgcatgtttagtgagcactaatacaatcttattccagaagactgtttttagtagcttattgtgaagtaagacaactataatgaatgtctgtcttgtttggaagtcatatctgtctttgcacaaatgtaccaatcgacaagtatattttatatattccataaaaatacaaagtaaccctgactagggcccaactttaattttgaatgcatttccagagtggccatgcctagagggcagatgcagagcaggtggtagtgggacaggacaattggagcacaggaatgttaacatgtatgacaggggaccagtagggtggtttccctctcaggcccagcagcccattgacagcattagactggcggcatggtgcttttctgagcagatcaatactctgcagactcgaaaaaacatcacatacattcttggaacttcccagtggtttaatctatgtgcatggttagggagccaggtctggaatattcagtttccctgcccctgttaaagaatcagaggttgggcagtcatcaaattcatcataaagacatgggcaagtgtgtctgtggtttccaaggcccccctatggagaatccaaaagtattttccattgccgtgctctttga

SEQ ID NO: 19964 - DNA, 6406 bp, Homo sapiens
ggggctggacccggcgcggagctggctgagtcggagcgcagcgtcctttgtgcccggcggccgccccgggatgcgtccgagctaggagccagatccaggatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacataatcctttgtacaaagctcctcttttccctttttttacatacacaagatcctcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaacctgcccgtcaccacctga

SEQ ID NO: 19965 - DNA, 2580 bp, Homo sapiens
gggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagtacaatgtccatgccactgtaaggtaccagtgcaatgaaggatttgcccagcaccatgtggccaccattcgatgccggagcaatggcaagtgggacaggccccaaattgtctgcaccaaacccagacgttcacatcggatgcggcgacaccaccaccaccaccaacaccaccaccagcatcaccaccacaaatcccgcaaggagcgcagaaaacacaagaaacacccaacggaggactgggagaaggacgaagggaatttctgctgaagaaccagaaaaaagaaagcacaacacctttcccatgcctcctctggagccttcgcctggggagacagaacccagagagaaacaagagagtccagaagtccctgaaccccaaaccacatcccccacacacaaaaattttcctttgtttgcggggggctggggatgcagtgttttttggggggtcttggtttatgctccctgcccttgag

SEQ ID NO: 19966 - DNA, 6406 bp, Homo sapiens; identical to SEQ ID NO: 19964

SEQ ID NO: 19967 - DNA, 3433 bp, Homo sapiens
agccaggagtgggcaacgcggcgtgagcagcggcccgaggctcccggagcatcgcgctgggagaagacttcgccgctcggggccgcagcctgtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaa

SEQ ID NO: 19968 - DNA, 3683 bp, Homo sapiens
cgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtga

SEQ ID NO: 19969 - DNA, 3677 bp, Homo sapiens
cctcccccgggaagggcaatgccggccgcgagaccaagggggaggaggggcagtgctgggcgggtaaaactacgcacaagcgaaggaatctgggcccccagcctctcgccgcccgctctccagaggcagtctgcaccttgcctccttcgctcgagccccagcccccagactcgggcaatacccacaagcaagatggcggcaacggcggcaccccctactgcttagcaccctgacttgccattggccagagcccggagtgaagcagccgcggattcgtcaagagcggtgcgggggtgggggtggagctgcagcagcctggagccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtg

SEQ ID NO: 19970 - DNA, 1390 bp, Homo sapiens
tattggcccattttacaagtaaagaaacagacccagaaaagttaattacccaaggtcacacagtgagcatctaaggcagggtttcaacgcaggcagtctgattccaggctgtgccctggctcctgcatgtgtctacacagaggactagggaagggtctgacacagcagctggcctgtccgattcatgccccactccttccgttaccttgcagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgctt

SEQ ID NO: 19971 - DNA, 986 bp, Homo sapiens
cctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccaggctccatcagttcacagctaccaggtgctgaacacatgccctgctaaacacatcatgagacctcattcagcccttccaagaatcctctgaagggttctgattttacagacaaagcaactttggcatggataagtgattggctcaaggtgttgccgctagtcagtgccagagccaggactccacacaggccatccgactccccagcccacatctttcacttgtacagcagattgccaaactcatgttgatgtggccaggccttgtgggggctctggtgctctcaagtacagatgaaacactgcacccccgcccccatgtcactgggttgctgccaagtggccctgccatatcctcccatttttaaagaagtcaggaatcctaatttgtatgtgaaacccaacttttgaatgtcagtaactatctttaattaaataactactgatccaacaaaa

SEQ ID NO: 19972 - DNA, 930 bp, Homo sapiens
ctgagagccctggctggaggggtggggtccccaaaggggcctccaagccttccctgttgagcgtcttgtattctcacttctgaagcgtatctctgcctctgaagaagggaggggaaaggaagcctggggtgtccttttctcccatgtcagcctgagtccggataatcgaacttcacccatttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctg

SEQ ID NO: 19973 - DNA, 3402 bp, Homo sapiens
attttcaaatccccggatgacggcggtggcggctgcagtccgctgacaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataa

SEQ ID NO: 19974 - DNA, 2689 bp, Homo sapiens
atggtggcacatgatgagactggaggtctcctacctattaaaaggaccatacgagtcctagatgtcaataaccagtccttcagagaacaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatt

SEQ ID NO: 19975 - DNA, 3253 bp, Homo sapiens
aagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataa

SEQ ID NO: 19976 - DNA, 637 bp, Homo sapiens
agaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgct

SEQ ID NO: 19977 - DNA, 2016 bp, Homo sapiens
gatttgttcagaaaataatatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggaatgacctctgatgtttgctggatgtttttaggcaatatatgaaatgtcccgaggtgaacaggatttaattgaggatctcaaacttgcaagaaaggcctatcatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcat

SEQ ID NO: 19978 - DNA, 3783 bp, Homo sapiens
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaatgttgctgctgttattctctttccctgggaaggctgggggcagggcaggggaggtctggatgtgacaccccagactgcatgggactgagcaagcatcagt

SEQ ID NO: 19979 - DNA, 2987 bp, Homo sapiens
aaaagggccggcgccctggtgctgccgcagtgcctcccgccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagctaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaa

SEQ ID NO: 19980 - DNA, 4020 bp, Homo sapiens
tttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccactgggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacata

SEQ ID NO: 19981 - DNA, 2515 bp, Homo sapiens
gtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatag

SEQ ID NO: 19982 - DNA, 3148 bp, Homo sapiens
gtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaacccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaac

SEQ ID NO: 19983 - DNA, 2852 bp, Homo sapiens
tgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcgcggcgtccggaggccccagggttatgagactatcactgctcaggacctactaacaacaaaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaaaccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccgggagcggaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcctgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcacaagcaataattaggatctatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatctaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtga

SEQ ID NO: 19984 - DNA, 3053 bp, Homo sapiens
tagaggctggtaccccgcctggtagagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagcgcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgccgcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgcccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccccaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccccaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaaaaaaaaaaaaaaaaaaaaaaaaaagctaagaggcgacggaagccgaacgcagagtccggatcggagagaaaacgcagtaaggacttttagaagcaataaaaggcaaaaaaaacaaaaaacaaaaaaacaaacaaaaaaaaaccactactaccaataatcaaagacacaaatatctatgcaaggaggctccactgagcctcgcggcccggcccggccccgggatgccccgcccggcctgcgggccgccccgcccgagcgcggatctgtgcactttggtgaagtgggggcccgcgccgccccctccccctccccaggttcttacaatcagtgactcggagatttggggccccagtgccactgccctcccccgccccgtccccgttgtgcgtcatgctgttttttaaaaacctgtttccaaatttgtatggaatggcaaactgttggggggtcggtttggggagggagggtttgcatgaaagacacacgcacaccacaccgcacgcacaagcaggcccggcgccggcgtccggggggcagaaggaggtgagctcgccggctcctcctccccgcggccattctgtcccctcctggggtgaggggtggggatggagacctgggggcagccccacccctgcccggactgtgcctcggtgggtgccacctggcgatttccggtgtctggagagagtattttttggtccaaggagtcctcttggctttagctggtgggtgggcggggagaggtctgagggctcctactggaggttcccccaaaaaggggcaaaaggagaccctctgcccaccggaggcaggggatcaggcatccaaatacacgatgcaaaaatgcaatcccacaggcgacacacccacacactcacccacacacacgcaattttaccttcctcttgtagcgaagatgaaactcccgtcggacacccgaagtgcattgcgtgtttctgttcagtttaatgacgattaataaatatttatgtaaatgagatgcaaagccgga

SEQ ID NO: 19985 - DNA, 3953 bp, Homo sapiens
aaaactgcagcaagtcagaggctccggccagagagcaggagctgcccagaggcttgtggtcctgaaagctcctctccggggagctaaccagggagaggaggtactgaagagcgactaaactggctgcagcggagagatcagcccgaaggcgtccttgaggagcatacggaactccaaggaaggagtagaataaggagcaggcagagaaaccagacccggtggaatctctaagaggtaacaaccgggtttgacatggatcgctgaaagcgtctcttctaccatctggatggtcagggagacttggcttctctgactgtcctctaagacgcagattcacagagttcactccaggaacggccagtgaccgagagtctggaaatgtcaaaaacttttgtaaaatccaaggagatgggagagctagtcaacacaccatcctggatggataaaggtctgggctcccaaaatgaggtgaaggaggaagagagcagaccaggtacttatgggatgctcagcagcttaactgaagagcatgacagtattgaggaagaagaagaagaggaagaagatggggagaaacctaagagaaggggtcccaagaaaaagaagatgaccaaagctcgccttgagagattcagggctcgaagagtcaaggctaatgccagagaacggacccggatgcatggcctgaatgacgccctggataacctgaggcgagtcatgccatgctactctaaaacccaaaaactttccaagatagagactcttagactggccaggaactatatttgggctttatctgaagtcctggagactggccagacacctgaagggaaaggctttgtggagatgctgtgtaaagggctctctcagcccacaagcaacctggtggctggatgtctccaactgggccctcagtctgtcctcctggagaagcacgaggataaatctcctatttgtgactctgccatctctgtccacaacttcaactatcagtctccggggcttcctagccctccttatggtcatatggaaacacatctccttcatctcaagccccaagtattcaagagtttgggagaatcgtcctttgggagccatctgcctgactgcagtacacccccttatgagggcccactcactccacccctgagcatcagtgggaacttctccttgaagcaagatgggtctcctgacctagaaaaatcctacagcttcatgccacattacccttcttcaagtctaagctcagggcatgtgcattcaactccttttcaggctggtaccccccgttatgatgttcctatagacatgtcctatgattcctacccccatcatggtattgggacccaactcaatacagtcttcactgagtgaggcagttaagttcaatgtttcagagaatgacgtggagacattttccataattcaagtggttgagctaaagattcaatgaccttaaaggatccctatggatatatatcaaacaatagttcaagtccatttaggctttccttcacctatcacctcttttctcatcaccttctcacattgcattgatttctttatagagtcctcaagtgaaaatatttgatgatttaacaaccatgtgaaaatagaacagaagacctgggccctattccagtggtgccaaaaactcattgcataatctgtgccaattaattttccatttctggcctttgtttatttactagcaattgtaaataaacaaattgtatttatatgaggcaactattctaagtccagatgatttctaaagtccttcacagttctgaaatgctataactgtggtgatcactcttgacaatttcttgaaactgaaagaatagagaaataataggaaagggatgctatgcatagaatgatcaaattgaattatcagagggatcacaaggtacatgtctcttggctcacagaatgcaaagcttgtttggatttaatgataggacctctttgtatctattgaaaaatagcttctggaagctaaaagtctaacatggctgtcactgtgaagaacaaaacatgttcgttaagagactaactctatttgttattagactaaaagttgaacatatcttccttatgatttgaagaaccataatagagaaccataatagaggcctcatgccaactttattcttgataatatttcaaaaccatttttctcagtactagaggtagggcaaacaagtcactgaagcctcagactcctataactaatgggacatagagaagtcttttagaccatgacctccataaccagagggctctggaacttctgatgaagctcaggtgctgctgttagaatcagcacacaacacaggtttatattaaagagcaataaaatagctattggctataataactactatagttcagggactctctccagctcacagttgcccatgggaaaaaccaatggatttttttttaagcaagatgaatttcatttggttaaacgtgattaaaaccatccacctctgtccacaccaatatattttccagaagcacaagcaccaatcaatttattgatcaaggttaaatttttccaacatatatgtagttccttatctctccccctacactaattgttacctcttcctcacttctaagatagaatatgttattatatattgtaaataacatttcaggtgaccaaacttaaggatgcagaaatgaaatccaaggttggtgaatatttttaccaactatgtcttcatcacaggtttaacccaatttgcagagtgtttatttttctttatgtaactcctttttcctttatatcaatgctaacttcatcaaatttgtattttttttcagaaaatgggacctgagaaattttcctatcttgttcaatcagccaggacagttatttaagtcaaaccagagcctgaatggcttatttgatagtagattaggtcctgctcctgccagaaaggataagtttaacatgcagggtacatcaatagggccaatttaaaaaatgataacacatattagtatgtcattttctatagctcagctatcccctaaaatctgccaactatatgtgtatcttgtctgtttacctctcttatttattatctccatacagtataagttattttttttccattttgctctcagcacttaccctgctgtattttgcacccttggtttgtaaattcacttgaaagtagccttgcagagagatcttaagccccatcagtcaccaaagtggttcccttcatcacaatctgccctagaggaaataggcaagtaaaatgatatataaagccatactatgtgctttctgagtatatactgcacttacctttgtgagcggctgtaggagggtctatcctcgaagctagcattttctggcatttaagtttgtagataatcactgttgtttgagttatttattagatattatttatttaatttatttctctcttcctttcacgaaaattcctttagccccatagatgtgcttgcaaacccttcctaaaattttatttggaaagtagctcataattttgctaagaactgctgagttttggagtgaggggaaaggaaaaaatagagaattacctctgtgataatttttataaaaagcagcaataattcgaatggctatgcaagttaatgtttttagagtcttttcttcagtctaaaatgagccagagttattctttaataatctgctgtttatgcctttggggagtatggtacccatgagccaagcctccctgaaattgtacagagggattttataattgaattaaaatttaggaatgcaatagcttgtaaagagcctgctctccaacatagggtggtctcattcttctggagacttttttagataaagtaaaataattgtttaaatattttgtttaaaatatgactgtttttcctccctttttcctagcagaaataaagctgtaagtcttatt

SEQ ID NO: 19986 - DNA, 2131 bp, Homo sapiens
agtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaggac

SEQ ID NO: 19987 - DNA, 1649 bp, Homo sapiens
cacacgagctgatctgatcgccggcgacatcactcaggagaccggccgggcgcgtggcccctgcaggcgaggcgaggaggccaggccaagttctccgtgcgcccctgcacccttccaggctctcgcacccgcaactggcacagagtaacaaccccaggctgttgggaacgtaagtgcgccctggcggctctgccctcagtccgggctgcagcgctctgagcgcctttctatctgtccgtcggtcctgcacagcgcaacgatgccagcccgccttgagacctgcatctccgacctcgactgcgccagcagcagcggcagtgacctatccggcttcctcaccgacgaggaagactgtgccagactccaacaggcagcctccgcttcggggccgcccgcgccggcccgcaggggcgcgcccaatatctcccgggcgtctgaggttccaggggcacaggacgacgagcaggagaggcggcggcgccgcggccggacgcgggtccgctccgaggcgctgctgcactcgctgcgcaggagccggcgcgtcaaggccaacgatcgcgagcgcaaccgcatgcacaacttgaacgcggccctggacgcactgcgcagcgtgctgccctcgttccccgacgacaccaagctcaccaaaatcgagacgctgcgcttcgcctacaactacatctgggctctggccgagacactgcgcctggcggatcaagggctgcccggaggcggtgcccgggagcgcctcctgccgccgcagtgcgtcccctgcctgcccggtcccccaagccccgccagcgacgcggagtcctggggctcaggtgccgccgccgcctccccgctctctgaccccagtagcccagccgcctccgaagacttcacctaccgccccggcgaccctgttttctccttcccaagcctgcccaaagacttgctccacacaacgccctgtttcattccttaccactaggccctttgtagacactgttactttccccctcccctagtcagcaggcaatagatggggccccagctgccgcctcgggaccccctctccaggcggagggaggaagcgggagctttaaagcagtcggggatacctgagccgcttgttaggtcgccgcaccctcgcggcggatgtctcttggtctgtttctccggccctcagcccagcgcccctcctgcccgcccctagacggcctttccttttgcactttctgaactccacaaaacctcctttgtgactggctcagaactgaccccagccaccacttcagtgtgatttagaaaagggacagatcagcccctgaagacgaggtgaaaagtcaattttacaatttgtagaactctaatgaagaaaaacgagcatgaaaattcggtttgagccggctgacaatacaatgaaaaggcttaaaaagcagagacaaggagtgggcttcatgcattatggatcccgacccccaccactgcagactcgctctaggaagaactggagactcttgcttagctattcaggcacagggctggagagtactttaatttattcaagatgcttcattcatatgaaaatgtatttttgtacataaagagtttattctattatgagctatcaaagtttacatttttgtactgcagacgcttcatgt

SEQ ID NO: 19988 - DNA, 1376 bp, Homo sapiens
gctctctattcttttgcgccggtagaaaggatgacgcctcaaccctcgggtgcgcccactgtccaagtgacccgtgagacggagcggtccttccccagagcctcggaagacgaagtgacctgccccacgtccgccccgcccagccccactcgcacacgggggaactgcgcagaggcggaagagggaggctgccgaggggccccgaggaagctccgggcacggcgcgggggacgcagccggcctaagagcgagttggcactgagcaagcagcgacggagtcggcgaaagaaggccaacgaccgcgagcgcaatcgaatgcacaacctcaactcggcactggacgccctgcgcggtgtcctgcccaccttcccagacgacgcgaagctcaccaagatcgagacgctgcgcttcgcccacaactacatctgggcgctgactcaaacgctgcgcatagcggaccacagcttgtacgcgctggagccgccggcgccgcactgcggggagctgggcagcccaggcggttcccccggggactgggggtccctctactccccagtctcccaggctggcagcctgagtcccgccgcgtcgctggaggagcgacccgggctgctgggggccaccttttccgcctgcttgagcccaggcagtctggctttctcagattttctgtgaaaggacctgtctgtcgctgggctgtgggtgctaagggtaagggagagggagggagccgggagccgtagagggtggccgacggcggcggccctcaaaagcacttgttccttctgcttctccctggctgacccctggccggcccaggcctccacgggggcggcaggctgggttcattccccggccctccgagccgcgccaacgcacgcaacccttgctgctgcccgcgcgaagtgggcattgcaaagtgcgctcattttaggcctcctctctgccaccaccccataatctcattcaaagaatactagaatggtagcactacccggccggagccgcccaccgtcttgggtcgccctaccctcactcaagtctgtctgcctctcagtctcttaccacccctcctccaatgtgattcaatccaatgtttggtctctcagcgcttactccccttgccttgctccaaagacgctgccgatctgctctactcccaatcaggtccgggatttcagggcgcctcactctgccttaaagccacgaaggcgaccctctgccttctcctcgtgcacttttcggagccattgccctcccggggcggaagaccaggctgtgaactgggaaagcgctagcccggccagggagcatctccccagcctccctgcgaactgcgcctgaaacgtgagctgcgctgcaggtgcctggagcac

SEQ ID NO: 19989 - DNA, 1884 bp, Homo sapiens
ttcccaggccaccatagcggctggcggagggagcgcgcgccttgctggcctggagggggcgggggccgtggcggctttaaagcgcccagcccaggcgtcgcggggtggggcggctctggcggctgcggggcgcagggcgcagcggccaagcggggtccccggaagcacagctggggtgtctccacctacgactggccgcgcgccttttctctcccgcgccagggaaggagcggctgcggcccccgccgggcggaggcacggggggcgtacgaggggcggaggggaccgcgtcgcggaggagatggcgcggcacgtgcggtgacggcacccgagccctgagggtcccagccccgcgctccgcgtccccgggacagcatggagcgcccggagcccgagctgatccggcagagctggcgggcagtgagccgcagcccgctggagcacggcaccgtcctgtttgccaggctgtttgccctggagcctgacctgctgcccctcttccagtacaactgccgccagttctccagcccagaggactgtctctcctcgcctgagttcctggaccacatcaggaaggtgatgctcgtgattgatgctgcagtgaccaatgtggaagacctgtcctcactggaggagtaccttgccagcctgggcaggaagcaccgggcagtgggtgtgaagctcagctccttctcgacagtgggtgagtctctgctctacatgctggagaagtgtctgggccctgccttcacaccagccacacgggctgcctggagccaactctacggggccgtagtgcaggccatgagtcgaggctgggatggcgagtaagaggcgaccccgcccggcagcccccatccatctgtgtctgtctgttggcctgtatctgttgtagcccaggctccccaagcttccctgcatcttggtccttgtccccttggccacactggagaggtgatggggcagggctgggtctcagtatcctagagtccagctgcagaaggagtggcttttcctccaggaaggggcttctgggtgtcccctcatccccagtagcctctttcttgcgtttctttttaccttttttggcactccctctgaccccgcgatgagtgttttggtggcagaggtgggatgagctggaaaggtatggaggtgggagaggatggggctcttctgtctgtcctgcttcttcaggtgagtgcaggccaaggcgggggtgagatggctgagcttccagcgccttctgtcctgcctgcccagtcccttcactgctttcctgccccaagatggcttgcttttcacaaataaagagaaagagcagctttagccttcttggtggaatcccaggcagtgggagcagaatcagaactgccagggaagggaagggggacctgggtctcaatgggtctcatttgagtctcgcgggctgtgcagatgccctgacagagtcggtttcctttggcggcattccctttccctcattcagcacttctgctgggaactccctgactattccgctgctgcaggaacccagctagctggccaggtggggaggggctggggaccggccaggaaggaggggtgacttcatcccagagagacccgagttcccccagcccttcatcaccaacccgctcctgcaggagtgagtcttacctcccctggccctcctttctggctcagcctgcagcgactgtgaggccacagctcctcagattcactgcccgctgtgtgccagtactcaggcagctggagagaagagaaggcagcagcagaggcccccgccctcaccccagccatctgcacttgtaccatttgctctgtgctgactgtggtcctataaattcatgagaaataaactggttctgtgtgcctctctga

SEQ ID NO: 19990 - DNA, 1218 bp, Homo sapiens
gagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtg

SEQ ID NO: 19991 - DNA, 1215 bp, Homo sapiens
gagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtg

SEQ ID NO: 19992 - DNA, 1969 bp, Homo sapiens
ccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaccttttctctcctcagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgttcagagggtgccgggggagggagtttgggtgcacaaggcctccgcttgcaacttgaacaagcctccttgggccaaaccagaaaccaacaatcgggggctggtggggtgaagtggaggggcacctaggttgaaacccacccctttgacccgaccaaacttcctgcctaccttttctcggacttcaagcccattccttctcttactgttaatactctgagccgcctagaggaattcgccataccagcagaaagaagaaggagacagtatggtacccacagactttaattattgatattccccctcaccgccctcagggatcgggagaagtcacacgaccatagggagcttggacttggtggtcgtcacggtgctggcagacgagggtctttccaggaaccccttgctagaatcagccctcatacaagtgtgctcagagatcccaggagcgatggcatcctccctgatgggtataggcaagttctgagtgaacagtagaagcctcctgcggaggagggccgtcctctaacctggggactcttaaatttcactgtgcttgagaataatctgcggaactttggttaaaatgaaatttctgggcctcatcactccccaacgcacaactacaggaaggctagaagtggcctgaatctgaatgtataactagttcccggtgatttctgtccaggtaatctgaggactccacctggagaaatgttgctctgatccctatcctagaccctgactggcagctaaagtggatgacaga

SEQ ID NO: 19993 - DNA, 2204 bp, Homo sapiens
gggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggtcagtgaactgctgggacttaggtgatcaggtgcaaggtggggagtacaaattgagtctctttggatttgccattctgggtctcaccaagccctgtagtatctcttccatactgggcaataatctccttaggtgggcttttattttttgctttcctgagctggaaatcagcatcattcacaaaatgaatctctggattctgcctctaaggtcccacagctcctgttcaggcttccctaaatagaactggtaaagtgtcacttgaaggaaccattatcccatttcaattttattcctacttctcgtcttttgtcctgggaagatattcagggtactgcctaggagaccccacccctgtgagcccttccctctagatgtcctgttttcctgtccctttagcttttccaactgtcctttgcctcattcttggtttcccttcctttcaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttgcttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggcaaaaaaaaaaaaaaaaaaa

SEQ ID NO: 19994 - DNA, 1143 bp, Homo sapiens
gacaccggaaggggtgggctttgcgaagatggcggcgctgggggtgctggagtccgacctgccaagtgccgtgacacttctgaaaaatctccaggagcaagtgatggctgtaactgcacaagtgaaatcactgacacaaaaagttcaagctggtgcctatcctacagaaaagggtctcagcttcttggaagtgaaagaccagctgctgctcatgtaccttatggatttgacccacctcattctggacaaagcctcaggaggatctcttcagggacatgatgcagttttgagactggtggagattcgcacggttttggaaaagcttcgtcccttggaccaaaagctgaagtatcaaattgacaagctgatcaagactgcagtgacaggcagccttagtgagaatgacccacttcgttttaagcctcatcccagcaatatgatgagcaagttgagctctgaggatgaggaggaagatgaagcagaagatgaccagtctgaggcttcagggaagaaatctgtgaagggagtgtctaagaaatatgttcctccacgcttggttccagtacattatgatgaaacagaagctgagcgggagaagaagcgtctagaacgagccaagagacgggcattgagcagctctgtcattcgtgaacttaaggagcagtactcagatgctccagaggaaatccgtgatgctcggcatccccatgttacccgccagagtcaggaggaccaacacaggattaactatgaggagagcatgatggtgcgtttgagcgtcagtaagcgagagaaaggacggcgaaaacgagcaaatgtcatgagctcacaacttcattcccttacacacttcagtgacatcagtgctttgacagggggaactgttcatcttgatgaggatcagaatcctattaagaagcggaagaagatacctcagaaaggtcggaagaaaaaaggttttcggaggcggcggtgattatgggtgtacatatttgtatattttttgtcatcctgagatacttctaatttcattgtatataggtggttttccctggaattcattaattgtttgctttggacatgtggaaagagccttactaataaaattgattttgcttatgaattaaagcccctttttgcaca

SEQ ID NO: 19995 - DNA, 5092 bp, Homo sapiens
gaattcatttttgaggtcaatttccaatcgagataaatctattggattagtaggattatctgattgcagccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttct

SEQ ID NO: 19996 - DNA, 2592 bp, Homo sapiens
atggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgtaaaaagaatatccaaggaatgtgccagaaagcccggcaagaaaatatgtagaaaaggaggtccccttacaaagaaacagacagatgatttaggtgataatgacggtgctgaagatgaagatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatag

SEQ ID NO: 19997 - DNA, 635 bp, Homo sapiens
gagagcgcgcccgggcggccagcgccgagcgcgcggagctggcgtggggagacacggcaggaaaggcgagtcggagtgggtgatgagaggccgggagagcccgtccgagccggagagaccggagagaagggagcgagcgactgtgcggcgctcacgctgccagagcccgggcggagtgcagtcgcctccaaagccttagagcggcgccccagtcactgcagctcttcaccctagagctgtgccctgggaccacagagaccaagagcatggaaatcggctgagaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaatt

SEQ ID NO: 19998 - DNA, 771 bp, Homo sapiens
cggaaattctgcatattgaagcaggtggctcctggtacgaaatctctggatacatttggcttgccaagttttgctcttcgctgtcccctcccgtttacagaagcatctgtggtgcttttcattttggatttacatgcaggaaacgtatatatgtttatataccgaccgcataatatataaatacatatacgcgtgcccaagggcctggttttcgtctctcctccccacgaaacggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttgg

SEQ ID NO: 19999 - DNA, 8242 bp, Homo sapiens
cgttctccaccgactcctgcccgcctcaacacaatgccttacctgtgaagcttgaggccactcaagttccaaatttgtgacaaatcccccagggctcactggagtggcagatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaagaaaaaaaggaaaagaagaacaaagaaacatgactgtctcaaagagtaatttttctagattagaccagtcaggtttttgaagacatataggtaacttccacagaaaacacaaacatgtatttaaaggcaagtctcatctaagatgaaactcataaaaattatttaatgtttgttatgaatttaaaagctccagaaatccatgaaaaaaagaaagattagctttgtgttgttaaatatctcttaggtacagatgttgtagaaataaagtgccaattgttttcagttagttagaaaaacaagttccaattctagtcatcaaggaaaaggtctattgaaaagaaatttgcaatatttcatggaatacaaataactaggttcataaaatgggggtgattaaactaccataaagtaatgaatagaaagttgccatgctaagagaatgtaaaagtgctgagcaagatattaaactgacactaaaagataaaaatctatttcaaggaatttatgtgattataatcccccctcccaattattatctatcaaagaaatgtaggtattcctccataattaaaaaaaagtctctgttagaagcaaaagtcttcaaaatccagagtgatctacatacagcttttgactgaggtggttatgcttttcaactgtgaactgccagtgtacacaaatacaaataattgtttagcatctgaagtattgttcaattggaacactgtattttactgtattaattaaacaaaacacaagaacagaatagaaatgacaacaaaataagatatgaatgaatactttcatatgcattgcttcatttggcaaaaccaaacattctattaaatagtatgttttaacgatggccatatttatatcatctacctaccaatctattgctctgcatttatcaatctgcctatatatagcataactgtcaccctctttatattaatttaggaaaatgattgaggaaaacaaagcatagccctattaattattttctctaaattagggtagaataactttatggaagataaagcagcctaggtttaattgttgttcaccagtcacgtgataaagtcattgtgaatgagtgttagttgctagttttataattgcagtctctagtttctgaatgaaaaaggatgccccacattatacagaacattaagaactgtttttaaagctgaaacataatctttatatgcaagaaaaataaatactgttactcaattttagcaaatatgtttaaaatgtatttatttagataattttctttgaaaaacaatgtaagtaacaaaattaaaataatatttttggcattatttgttaattcagattttcctgcctccgattaaaaattaggcaaagctgcttataatttatacaaagattacactaaaatgaactttatttcattgttttgctgttatataaaatttttaccaaatgtttaccaagagattaatgttttagagtatgaggatagaaaaataaaagtgacagatttcatagttttaaatctctactgaacatgttgactatgaacaaaatctaattggctaccacagatatataacaaagtttattactaactttatgcaaattggaaaataatttgctaaagcattaaaaatgtcagatttgtagacgtcttgctggcaactcaaagcagaaaatctgagtatatattattttattcctcatttcaaatataaaagttgaccaaagtgatgctttatttccgacttcctgatctgtatgtgaaaacagcaacatttttttaaaaattatcaagtatatataatattaaaaagaggaaaacagatggcactaattttcttacaggagtgaagtgctgaaactaaattgttacatctgtaacaacagttatttcacctcttgccacactcatcctgacatacgtattaatatcaaaaaatgatacaaagaatatgagaaatgtgttccagcattaaagacactactacatagaaattactgggattcttttctttggcgagtttcactgaaatagtttcacaggatgaaatgatgaattgaattcttaagaagctgtcaaatatggcagtcttttgatgttagtaattttgttttcttctgtgttattggttcaaagtactggccttttccttcatttccagtaattagttgttatagactatcactttttaatgtgagtggaaattagatgatttggttatacttgtgaaaacatgcttccaaataaattcaattaatgggcacttccctgctgagattttgttatcattcatttgattatcttgtcaagctttactgttacgacaaatgttttagctttctggtcaatagactaagggaatttctccagtagccttatacctctcctgcacttgatctgatagcaacatacacttcaaatttccatcagaagtctctaaagaaatttcctactgctatgaaacatttggtggccaacttgattctttttcataagcattctgatttgattttattctggcacgttgctgtatttggatgcaggccagaaatcaattccatttgataagggttgtggagaatacagactggaataaccgtgtgcagggcttaagtgccttttcctcctgagattttatttataaaacttagcttttttaaattttcagattcagataattcaatttaaagagtacaataggatgactatattataaattaccaataaagaaagtttatttggacatttttacatttaatttgatttttaaaataatatcagatgcatctaaatggcttccgggaaagactgaggtaaatttttgaaagtgacaattatataggcatctgacttgatggtacttaagaataaaaatttaaatctctagcaaactttaaaaattgtccaaatagtaagtttaatttgaaagaagtctgaagctattagagaaaatcatgtactagataggtatatatttttttctagtcagctattacgtacaccacataatatatataccctatatactatatggtttatataacatttataatggccctttcagacccatatacttacaaatgacattgtataactacctacatatgtattaatgtgacagaatttagtcctttatggaaagtcaaaccaaattgctagcagttttgagttgaaatgaatgataacaattaaagcttttaagaaattggtaaaggtaccgtaacaaaaactcagcagataaatttaaaagagagggaccatttttgaatgccattttcagagttgacatctaaactagatggtgtgtttaaaaggattttagtggttttgattcatcctttctctgcattcatatcatttagcaaattaatgggacatatgtcatggtttttgtaaaaaagaccattgggttgtcatgattcagtttgtgtttggacatctatggctttcattaaaaacgtgtttattatcatgaataaatattaccatgttttccaa

SEQ ID NO: 20000 - DNA, 2719 bp, Homo sapiens
atggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataagaccaactttgtacatcttggccatgtcactggtcattgtgtgaaataaagataatctggataatgactattagtccaatgctaagaaacatgatctttgctcattaaagagctaaaatgtttattgctgttttgtctttcttttttct

SEQ ID NO: 20001 - DNA, 4642 bp, Homo sapiens
tccctctcccccccttctctctctctccgaggggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgaggcgcccgcctcgtggcccggcgtgcgcaacgccaccaccctgccgcccgcctgcccgcagaacctgcacggggcgctgcccgccatcatgctgcctgtgtggttcaccgacaacttggaggcggccgccacctacgtgcagaaccagagcgaggactgcctgtacctcaacctctacgtgcccaccgaggacggtccgctcacaaaaaaacgtgacgaggcgacgctcaatccgccagacacagatatccgtgaccctgggaagaagcctgtgatgctgtttctccatggcggctcctacatggaggggaccggaaacatgttcgatggctcagtcctggctgcctatggcaacgtcattgtagccacgctcaactaccgtcttggggtgctcggttttctcagcaccggggaccaggctgcaaaaggcaactatgggctcctggaccagatccaggccctgcgctggctcagtgaaaacatcgcccactttgggggcgaccccgagcgtatcaccatctttggttccggggcaggggcctcctgcgtcaaccttctgatcctctcccaccattcagaagggctgttccagaaggccatcgcccagagtggcaccgccatttccagctggtctgtcaactaccagccgctcaagtacacgcggctgctggcagccaaggtgggctgtgaccgagaggacagcgctgaagctgtggagtgtctgcgccggaagccctcccgggagctggtggaccaggacgtgcagcctgcccgctaccacatcgcctttgggcccgtggtggatggcgacgtggtccccgatgaccctgagatcctcatgcagcagggagaattcctcaactacgacatgctcatcggcgtcaaccagggagagggcctcaagttcgtggaggactctgcagagagcgaggacggtgtgtctgccagcgcctttgacttcactgtctccaactttgtggacaacctgtatggctacccggaaggcaaggatgtgcttcgggagaccatcaagtttatgtacacagactgggccgaccgggacaatggcgaaatgcgccgcaaaaccctgctggcgctctttactgaccaccaatgggtggcaccagctgtggccactgccaagctgcacgccgactaccagtctcccgtctacttttacaccttctaccaccactgccaggcggagggccggcctgagtgggcagatgcggcgcacggggatgaactgccctatgtctttggcgtgcccatggtgggtgccaccgacctcttcccctgtaacttctccaagaatgacgtcatgctcagtgccgtggtcatgacctactggaccaacttcgccaagactggggaccccaaccagccggtgccgcaggataccaagttcatccacaccaagcccaatcgcttcgaggaggtggtgtggagcaaattcaacagcaaggagaagcagtatctgcacataggcctgaagccacgcgtgcgtgacaactaccgcgccaacaaggtggccttctggctggagctcgtgccccacctgcacaacctgcacacggagctcttcaccaccaccacgcgcctgcctccctacgccacgcgctggccgcctcgtccccccgctggcgccccgggcacacgccggcccccgccgcctgccaccctgcctcccgagcccgagcccgagcccggcccaagggcctatgaccgcttccccggggactcacgggactactccacggagctgagcgtcaccgtggccgtgggtgcctccctcctcttcctcaacatcctggcctttgctgccctctactacaagcgggaccggcggcaggagctgcggtgcaggcggcttagcccacctggcggctcaggctctggcgtgcctggtgggggccccctgctccccgccgcgggccgtgagctgccaccagaggaggagctggtgtcactgcagctgaagcggggtggtggcgtcggggcggaccctgccgaggctctgcgccctgcctgcccgcccgactacaccctggccctgcgccgggcaccggacgatgtgcctctcttggcccccggggccctgaccctgctgcccagtggcctggggccaccgccacccccaccgcccccctcccttcatcccttcgggcccttccccccgccccctcccaccgccaccagccacaacaacacgctaccccacccccactccaccactcgggtatagggggtgggtggggaggccctcctccccggccctccctggcccggccactccgaaggcagggaggaggacttggcaactggcttttctcctgtggagtcgtcacacgccatccagcagcgctaaggtggacatgggattcctccctgcgatgcgtgtctttcccacgcagagaagcccagtctcttctctggatctgggcctttgaacaactggggggcgttttctcccccccattgggacaccagtcttcggtgtgtggaatgtggtattttcccgcgtggaggtgtgctttctcacaacggggtgtgttttcccatgtgcagggtgaggtttttttttgccaccctggacacatgttggccccctcaaagaatttctgtggggatttgtaccccagaatcctgttcccccatcccttctcccacctcctcccctctccctccccctggagaccctggaagtggtgtgttcacatacagtgacccttggccaccagaccacagaggatggagcctgggaagcagcgaggaaatcacagccccctcgcccctgcctcccttgcccctaccccggcgaagcatgttccccccgacgccccccttggcacaagtcagatgaagcacgttctgccggggaggccctcaccttccagagaggacagacacagatttcctgctgggggagggaggagtccacgcatcctgatgctgcctggaagcttattttcccgtggccaggacgcatttctctgagtggaaacaggttcttgcatgtggatgtgtgtttccccaggcagacggcccctctcttcccagcacttccctgcctcccccaggcctcaggcccagcacccagttcctcctcacatggcaggtgagcacagacttctagttggcaggagctgaggagggtgaacaaaccccgagggaggcccggcccttgctcccgagttggggggagggggtgtggcaacgtgccccccgcagaggccacgcatgtttgaccaaagccctcattgtggtccgaggacagccttttccccaggcctcagagcattgctcatccgtgccaaactgggtaggtggatttgagcggaaagactcccaaaatgtgccaagaatttcccagtcccaggcagggcaggggaaactaagggcaagcaggatacagggcgagggatgtggcaggtgagggggctcccgcctgtgccccttctcctcaccatgtctcccccaccctgcctcagttctccgttccccttcatctccgtccccctctttgaagctgtccccatctcagtgtcagaccagccttctcctcagctgaccaccctcctctgacccacgccccctccttgtctgaaagaaaggagccttgaatggtggagggaggcagtggggagaaaggtctcaccggacaggttgggagaatgaggtcagcggtgctggggaacagatggagggggcagtggggacagggcttgggcagacaccagcaggaataatttgaaatgtgtgaggtgactccccggagggccttgggcttgggcatttgggaaaagaatgatgtctggaagggcttaagggacacagtggacgaggggagagtcctcatctgctggcattttgtggggtgttagtgccaaacttgaataggggctggggtgctgtcttccactgacacccaaatccagaatccctggtcttgagtccccagaactttgcctcttgactgtcccttctcttcctacctccatccatggaaaattagttattttctgatcctttcccctgcctggtctagctcctctccaaacagccatgccctccaaatgctagagacctgggccctgaaccctgtagacagatgccctcagaattggggcatgggaggggggctgggggaccccatgattcagccacggactccaatgcccagctcctctccccaaaacaatcccgacaatcccttatccctaccccaaccctttgcggctctgtacacatttttaaacctggcaaaagatgaagagaatattgtaaatataaaagtttaactgtt

SEQ ID NO: 20002 - DNA, 3046 bp, Homo sapiens
ccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgtaaagcggatttccaaggaatgcgcccgaaagcccaacaagaaaatttgtaggaaaggaggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacaca

SEQ ID NO: 20003 - DNA, 3913 bp, Homo sapiens
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaa

SEQ ID NO: 20004 - DNA, 1862 bp, Homo sapiens
gggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctca

SEQ ID NO: 20005 - DNA, 3863 bp, Homo sapiens
ccctcggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatgacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactccc

SEQ ID NO: 20006 - DNA, 3319 bp, Homo sapiens
ggtgcgcgggcacagcagccaggctgccggagagctgatctcggggattcgggtgcggagcccttggcctggaggcgatatgggtggtccgtggcccggttcagtcgcttgcagcagcccggggaacagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggatccggcgctaagaaacagggcgaggacttagcggataatgacggggatgaagatgaagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactggggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacact

SEQ ID NO: 20007 - DNA, 882 bp, Homo sapiens
ttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcagatgcaa

SEQ ID NO: 20008 - DNA, 5310 bp, Homo sapiens
gagacgaagcagggagagagtgaacttcagccccgtcccctccccactgccacggctggggcaacccaacccgcgcctgaagcggcttggcttgacctgcggaagcgcgggccgggatggcgtggggagagggaggtaggtgccactgggctgcagatgacgagtgggttgggggcttgctgtgggacaagaggttcaggttccggcctgcgccttccactccgcggtggcgctctctgcctgcggttttccaggaggccgatctaccccagggacactctcatccttcaggcggtctcctggacgccctttcctccccttgcctcccagcctgacctggctctttcgcccctcggagaaccggttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatctta

SEQ ID NO: 20009 - DNA, 5167 bp, Homo sapiens
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatgatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 20010 - DNA, 5338 bp, Homo sapiens
tttttttcccttccttcatctcctggcctcggataagataaggcttgggggatgcacgaaataatccaagtgattgattagacctggcatggcttggttgggctggagaaagatcggggcgcgctggaaaccccgcgtgaagatgaaatgactttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagcacaaaacaccctggctcatggaaactgcaagcatcgttgtcagctgcacctgcaggcaccacgggattgcaagtcagcataccctttcagaaatgaggatgaaattagagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttat

SEQ ID NO: 20011 - DNA, 6617 bp, Homo sapiens
tccaaacccggcaatgttggtggctcttgcattcctctggatgagcgaatctagttggggggttcccgaaggggaaggcgcctgggctttcaatacatcctcctgaatcatactgcgtttcaggttccttagaaaaatttggatgtgtaaaaagaactcttaacggcgatgcaggtcttccacagctaaggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttccaacatcatggtagcagcacacacttccaaagctcagccagggacacttaatattttttaattacaatggaaatttaaacatttttatgtgggctacacaatggatggctcttcttaagtgaagaaagactctataggcttttacacagcacatgaagcagtaatccagaaagaaggaaatgcagaattttattatcaaagtaagcgaattgactgtgcagaaaaattgtagggttctgtggaaggaggtattctgccagcctgaactatatttaagaaactttgtaaaaaataaaaatgtatatagctgtgagctcaaacaaaaactgcagacaaacaaaaaagagaaaagcttttatttgtgttttcagtttgaaagaacttttagcaaggttgtgctttcaaacacatattagtcctaccaccttagttcctctacagcaaaagaggcttttcttcttaattacatgtaaacaaagacatgggattttctgacgtaagattttcatttgtaggaatatgtgatgtcaaatggaagactcagaagttttgtgtggcctatttctccctgtcaggttgcacagatgcatgtagagcattcttaggagaccattgttttagaaaactttgatttgtacatgttagttttcatgaaattgcaacacagagataggtcctaaaagtggaatgtatttaaaacttgttgaattagacacacacacacagacacacacaaagaatcagcagagaaaacaaaatacaagtcctgttctgtagttcttgccctttgaatatatttgggaagagttgcttcctatttcaggaccctgccaaaaaagaagaaagcttgcctttggtggggctatgccccttggagtaaatacagctctgtgttccctagcagctgccggaggatttggctgatgaagtacctgctcagcttagctaatcagattaaaggaagacatgtatgtcttttgtttaagcacctagtcccttatgtatcagtaaacaggtttttaaaaatcttttatgtcatttataggataaaacatatgcttgtctgaaaatatcaccttttgtggatttatctgatcaccaaataataaatattaagaagaatgggggaaaaaggatagaatattaaaactgctttgcataggtttttggggaaattaggatatcttcactgacaagacactgaatggaatttattcacccattttaaattggttacttggggatcagagatttgtctctccaacagcttgtggttttcttattactcattttcaggaaagtttgtagtattacaaggcagaaggaaacacagtagcaatggttgctctatattttgtctttcaaagattactgcattaccaagaaacagtagccaaagatgtttgaagatcatgtcccttagctgcattgtgggttattctagaaatccaatgttaaatgcctctactaaagtggggattccccataaaaattgtccagctacctgactcttttgcaataacaactttgattactgaatccatacactcaaactatagtgatatatcagtgtttgggagtgacctctagaaaaaagaaaactgtttttagaaatacataaaatcacttccaaatcctgttgcttatgttgggttaaatttgaaagcaattctctatatataaatatgtgaaatattatgatctgaacttagcacacatgaagcaacatttctttgctacacagaggtgtcttggaaagatttcattcccaattcatttttcatagatctataatcaggcaatttctgcaagcaatgtatgaccccacctgagcaaccacaaataggctctccatgaaactgcaaaggaactgatgtgtggcatccatgctggttttgtctgtctataatatgaattcaagtatctgttcatatttccaattgtctcctgctagcaatatgtgccacaacatgacagtcttgtgacatcttaaggaaaagaagagttcctgttaaatgaatagctttagcttttacaggggattatgattaaaagtgatttagtacatcttacatgatatctcatttctacgtgaaaagaagttatagaatcttcatagagttccatgagaaaaatatacttgctatttatagaaaacgagaaaaaagaaaaaaatgagaaacaagtaagaaaaaatcctttcctaggcttttccttgatcttcagaggcacacagggtttaatggttccttaggttattattttgaggttttgttctttcttttgccttaagtaatgacagaagatatatatggccagacacatatgtataaacttttcagcagcattttaataataaaatatcacactattttctaatgctttgtacaaacaattatgcatctgttctttcttggtaggtggaatattttatttacttttgccattctttgaatgcctttttctttgtaaatgctacatggtagctctcacataggctacaaatggataaatacatttggtaatgggatggtttctttagctttggccagctgcacagttgaggaggctctgctggcctgattttggaaaaccaagccctgtttggtgaagctcctgagatgacactgcctgaaaatgagtatttggttgtgttatttctaccactgttcattcttgtgtctctgtgttttgatttgtgttcaacaaactgatgccttaatggtttcaaatagaaagccttaggtgagtaaaccttctagtgacagtaagaaattctactgaatgaaactccagaggcagaaaatcattgtcattccaatgggagctcaattgtcaattccttcctgtgcattcagccatcacgaacttatttcacattcacagtagctctaaggggcaggcacctgcattactcccctttcataatggaagatgttctgactttgaaacatgcccccttggacaggaaaatttgatggataacaggatagcatatcctcatatcccaatctttcaccaagaagttatacagcaaacacttgtaagtcaaggtcttgcatgataatctttgctaagtagcaagtaaagaaatatagcaaggacccagactctttggaatatgtgaactaaatccttcagatgttgttggcctcaatcatgttgtgaaggcacacaggagaatacatacacacacatatgcatatatgtatatatgtacatgtatgtgtacattatatatgagtatacatgtacctatcctatatatgtatgtatgtatagagtcacagactgcataatgttttggacaaatatagatcacatatatgatgatagtgtcttgagattaaaataccatgtttttattgtaccttttcagtgttcagatatgtttagacaaacaaatgcttatcattgtgttacagttgcctaaggtcttctctccagtcacatgctgtacaggtttgtagactggaagaactaggctataccatagagcctaggtgtgctataggctacacatcggttttgtgtaagtatactacatgatgtttgcacaatgatgaaattgcctaacgaaacttttctcagaaacctattgatacatgactgtgtatgtttacattatatatactgtatatgcacacatgcatatatgcatatatatgttatacatttacatatgtacatggatatcacatactttaaattcctgaagatgtcattttcattaaatacatatgcacacacactcataaacacacacagactcatatatacacacaaatctataacacatttgtgctcacatatacattcctctgtgtgtgtgtgtgtattacattactgctttttatctgtgaaatcacattctgcagtttcatttactgtgatcaactatgatctaaaaatatatgagtacttcaataagatattttgaaagaaaccacattcacataacatttatgacattataattgttctattttattagctattgttcatctcttactccatctactttataaattaagcttcataataagtgtgtatatttaataaaatatatagtata

SEQ ID NO: 20012 - DNA, 722 bp, Homo sapiens
taaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactaggtatgcaagaggcacgtttgtgtgggagctcaaaaatgtttaattattttaaatctcctttcactaatttaataaattttttttgagttcagatgcaa

SEQ ID NO: 20013 - DNA, 3003 bp, Homo sapiens
agtacaggggaaaaggagggaaaaggccagggctggagatggcgaaagcaggaggacttctgcaaactgttgcattggagttttcgaaagacttatctttctgcaggctcgcctctgagctttgtctccttggagccacctcacttagacagcttcggatgtggatgcagatttgaaccatgttgcgtccccagggactgctatggctccctttgttgttcacctctgtctgtgtcatgttaaactccaatgttcttctgtggataactgctcttgccatcaagttcaccctcattgacagccaagcacagtatccagttgtcaacacaaattatggtaaaatccagggcctaagaacaccattacccagtgagatcttgggtccagtggagcagtacttaggggtcccctatgcctcacccccaactggagagaggcggtttcagccaccagaatccccatcctcctggactggcatccgaaatgctactcagttttctgctgtgtgcccccagcacctggatgaaagattcttattgcatgacatgctgcccatctggtttaccaccagtttggatactttgatgacctatgttcaagatcaaaatgaagactgcctttacttaaacatctatgtgcccatggaagatggaaccaacataaagagaaatgcagacgatataaccagtaatgaccatggtgaagataaagatattcatgaacagaacagtaagaagcctgttatggtctatatccatgggggatcttacatggagggaaccggtaacatgattgatggcagcattttggccagctatgggaacgtcatcgttatcaccattaactaccgtctgggaatactagggtttttaagtaccggtgaccaggcagcaaaaggcaactatgggctcctggatcagattcaagcactgaggtggattgaggagaatgtcggagcctttggcggggaccccaagagagtgactatctttggctcgggggctggggcctcctgtgtcagcctgttgaccctgtcccactactcagaaggtctcttccagaaggccatcattcagagcggcactgccctgtccagctgggcagtgaactaccagccggccaagtacactcggatattggcagacaaggtcggctgcaacatgctggacaccacggacatggtagaatgtctgaagaacaagaactacaaggagctcatccagcagaccatcaccccggccacctaccacatagcctttgggccggtgatcgacggcgacgtcatcccagacgacccccagatcctgatggagcaaggcgagttcctcaactacgacatcatgctgggcgtcaaccaaggggaaggcctgaagttcgtggacggcatcgtggataacgaggacggtgtgacgcccaacgactttgacttctccgtgtccaacttcgtggacaacctttacggctaccctgaagggaaagacactttgcgggagactatcaagttcatgtacacagactgggccgataaggaaaacccggagacgcggcggaaaaccctggtggctctctttactgaccatcagtgggtggcccccgccgtggccaccgccgacctgcacgcgcagtacggctcccccacctacttctatgccttctatcatcactgccaaagcgaaatgaagcccagctgggcagattcggcccatggcgatgaagtcccctatgtcttcggcatccccatgatcggtcccacagagctcttcagttgtaatttctccaagaacgacgtcatgctcagtgccgtggtgatgacctactggacgaacttcgccaaaactggtgatccaaaccaaccagttcctcaggataccaagttcattcatacaaaacccaatcgctttgaagaagtggcctggtccaagtataatcccaaagaccagctctatctgcatattggcttgaaacccagagtgagagatcactaccgggcaacgaaagtggctttctggttggaattggttcctcatttgcacaacttgaacgagatattccagtatgtttcaacaaccacaaaggttcctccaccagacatgacatcatttccctatggcacccggcgatctcccgccaagatatggccaaccaccaaacgcccagcaatcactcctgccaacaatcccaaacactctaaggaccctcacaaaacagggcccgaggacacaactgtcctcattgaaaccaaacgagattattccaccgaattaagtgtcaccattgccgtcggggcgtcgctcctcttcctcaacatcttagcctttgcggcgctgtactacaaaaaggacaagaggcgccatgagactcacaggcaccccagtccccagagaaacaccacaaatgatatcactcacatccagaacgaagagatcatgtctctgcagatgaagcagctggaacacgatcacgagtgtgagtcgctgcaggcacacgacacgctgaggctcacctgccctccagactacaccctcacgctgcgccggtcgccggatgacatcccatttatgacgccaaacaccatcaccatgattccaaacacattgatggggatgcagcctttacacacttttaaaaccttcagtggaggacaaaacagtacaaatttaccccacggacattccaccactagagtatagcttttccctatttcccctcctatccctctgcccctactgctcagcaatgtaaaagagacaaataaggagaaagaaaatctccaaaccaggaatgtttttgtgccactgactttagataaaaatgcaaaagggcagtcatcctgtcccagcagacccttctcattggcattttccagtattgtgagatcaatttctgaccatatgaaatgtgaaaagtatatgtttctgttacaatactgctttaagatctaaaccatgccaacagatgtttcgtgtgactaggacatcaccatttcaaggaactgtgtgtttc

SEQ ID NO: 20014 - DNA, 2661 bp, Homo sapiens
agccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggt

SEQ ID NO: 20015 - DNA, 8661 bp, Homo sapiens
ggggctggtaggcgccggcgtggagctgccgcacgtgggagggcgctggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 20016 - DNA, 8354 bp, Homo sapiens
ggccaggcagccactgtggcctctgcggctaggccggctcgagactcccgggcgcccaggcgctgccgcccgcctcgccgccccacgccgaaggaccacgcgcccgccgccgccagcctctcagcgctcccatgatcgcccggtgccttttggctgtgcgaagcctccgcagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttagaaaagacagatgatgacaagtataaaattaccttaaaatatccacactatttccctgtcatgaagaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgttgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccagaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacattcttctggtaaatattttcttggagctctgtgtcaactttgatcctttgtctcccaggaaggtgtgacctctcctttgcctgcatacctcaaggccaggggaatatgcctcagtgatgcatttatctttgtatatcaggccgcatgattcccaactttctgccacacttaaattacgttcctccatttcagttttgtcttttctgtctaaagttcagtcaaagagtatcaaaaaattatgtttcagctagactggtgtaatgtataagtttttgtatcttgtattagaggatttcgtagcttttattagaggctcatttccacctcagcatacaagatcgttagtcttttggcatgtgtgccaattagaatactaaagcaagtccaagcacatttttctcttctcacgtttctaataagtgttagggactttgcctcttttacttaccacgtccccaaaagtgtcaggtagacatgtcacaaatggctctgtagagagccatgggaagagagaggaggtggatgtggaacataaagggttcagaaactccagaagaggagtgggttttggatagaagcatttgaggacagctgctccaaagccttatgtgtatgatgaaacttaaccacggggaagagactcttcagtagcctgttctgtctggtgatttttattttaagtgaacctttggatctatctttaactctctttattgtgagtctaaattccaattctgcagcagatcagtaaactcacagtatttttcctgtggaaatctattcaataaggaaaccaagacaggataataaaatttaaaaaaaaaacaactttgaattcccctgcctaggtcttccagttgttttccagcgcatacctcaggtatgactttgctagccggggacaaaattagcaccttccgattctctagtccaaatgaactttgtgctaaataaaaaattattatactacataataaagttacagatagcaggaaatgcaagagctaggagattcctagattatatctgccaagcaaataccttaaacatccacctgaaatcctactaccccctcttctgagataatttgcccagcccttctcttcccacacactcactcaatgtcacccccttctaatccccaaaactgtttttgtggtctttgtagcctatagtagttttctcacatctttccccctagacttttctgtttttcagtttcagacaaaaaaactcttcagctttttccagtgtgtctccttaacagtaactttaccacttgaaatcttatttcatagaaaaactaaattggtgtggaaaggctgcacacaataaagttatattattatccatgaaaatgaactcatatttctttcatactttaacgttaaaaccgaaatgcatgagagcaaaagcaccatggtgttctttctatttagggcctacctctaatatttaaaatctaccaaagagcagtcacaaaattaaaactcagcccgggcgcagtggctcatgcctgtaatcccagcactttgggaggccaaggcaggaggatcacctgaggtcagagttcaagaccagcatggtcaacatggtgaaaccctgtctctacaaaaatacaaaaagctgggcatgatgttgggttcctgtagtcccagctacttaggaggctgaggcaggagaatagcttgaacccgggaggtggaggttgcagtgagctgagatcatgccattgcactccagcctggacgacagagtgagattcagtctcaaaaaaaattaatactcaaagaattatctagcataatttaaaagaaaggactttttaaaaattctctagcataattcaaaagaaaggacttaacttttttttttttagtgtggtcatccgtctagttgttctttttttccagatcagagcagagaatatcactgacatgcttgaaatggtggataactatgtaaattgtaattggacaaatgtacactttagatttatggactgagccacatataataaggtctctcctggtaattgatccaggggatttaggcctctttcgggttttttgttttttttttaggcattgttatgttgtgaaggataaaatcttcaacatcttatgcaaatggatagtaggcatgatcctaaaggtttagttttacgatgctgcagagaagagaaatgtcttgacgttttgccacctgatgtagactttgtccccctctagtataaatgttgcatgttacctagataaacaactaaaaattgccttgagttatcacctgagctacttatgccaaggtcttgcctttctaaagctaataaggtgagaggtggatatctgtagctcttcggatgaaaaattgcattgtgggagataccaaaattgaggaaatagctcttcaaagaaaaattactgatatgatcattgtacttgtaaatgccttaagtagcaggcagtgactcaattttctactttaccattttacctttagcttttatgtatgaattataggtctgtggagattctgcctccccactaggccagtgtgtgtttaccatttattcattttctatcatacacaggtggattaaaatttacattaaaatttacattaaaataccatcatacttcaggcttctataacaaaatatcagactgggtggcttcaaaagcagacatttcttacagttctggaagctgggaagtcccacaatccacatgctggtaaatttggttcgtggtgaggcccctcttcctcttttactgaccacatccccaaaagtgtcaggtagacatgttacaaatagctctgtagagagccatgggaagagacaggaggcagatgtggaacataaagggtttagaaacttctgcaggcagcagtggcagggagcaagccctagagtgtctctttttacgagagcaggaatcccatcatgagagttccttcctcatgactttatctaaacccagtcacccccaacaaaggccccaccccctaaccccatcacattggctgttacggcttcaatgtaggggatggggcacaaacattcagtccataacgaatactgattcctcaaatagggtttaaacatagttaactgagcccccaaagaatgttaaaagagaaaatccattttatttgaatagatgcagtgaccacagcttcttccctcaaatcaacacattacagttagatgtctcccatctgaaattggatagcccactgaaattgaacatgccttctcttataaatgtgtggtgagaataaaagcaacaaagaaatgaatgtggtggctcacacctgtaatcctaacactttggaaggttgaggcaggaggatcctttgtgctcaagagtttgagaccagcctgagcaacacagtgagaccctgtctctacaaaaactaaaaaaattagctagggatggtggcacatgcctgtagtcccagctacttgggaggctgaggtgggaggattgcttgagcccaagaaggtcaaggctgccatgagccataatcacgccactgcactccagcctgggtgacagagaccctgtcttaaaataaaataaaaaaaaaaggaaaaggaaagacatacataccctcagttcttcgaaaaacagtcaacgtccaaaaagtttattttttgagtcacctttaatagagaaatttcccactggaaacagatccacctaagtgattatctagtatcagctgtatcaaggcaaaaggtaaaggttataagatgtaaatattagaccaaaatagccttttttaacaaacacaataatgctgtacgtctgtaacaaaacaaaatttgaaaaattgaggtaatgtacacagcgatgcacacacccccacaccacaccgtgattcctgagttttgatttggttgaattcaccttgtagttccctttcctgagaaaatacaggttcaacacatctagtccacgatgtacgtacaaggggaaggggtgaacaggaaatagactcccttattctgctcacatgagctggaacctgtactagctgcatatttcatagaccccagaggctcacctcaattgtactcctatgataaaatgtctctagcatttgtcatgagagaaactggctagaaatagtttgttcattgcgtccagcaagacacgcattgctgttgatatctttgtggctaagatggagaatgtgactggataatagttatccaggtggattactagctattgaaacagtctgagatagttgcatgatgattaacgttaaactgggagtaatttcaagtcatttggctaaaaatgaaaaaaaagtcccataaaaaggtatcaaatgtacagataatagggctggaattattaagtatgatgatgttattaacatctaaaattattttggccgggcaaggtgggtcacgcctgtaatctcagcactttgggatgccaagatgggtggatcacctgagttcaggagttcaagaccagcttggccaacatggcgaaacccgtctctactaaagaatacaaaaattagccaggtgttgtggcacatgcctgtactcccagctactcaggaggctgaggcagaagaatcatttgaaccccggaggtggaggttgcagtgagccgacattgtgccgcttcattccagcctgggcaacagagtgaaactcttgtctcaaaagtaaaaaaataataatgtttaaaaatatttcaatgtggagacaagctcaaaatgaaattagacacattccattacccaggtaaaagaaggggaagcctgacttgatagtagtattcaggaaaaaagagttggcagttttatttggccaaattccaatatcagctcatggtacagcacaccgggggagggggacgggaggcgagaactaaggctttttaagaatgtgttgatggaagtatgtgcctagatcaaaagaataatccccccggactccagtgtaagatcaattactgttggaatattgtgttcctttctagatatcacattttaagcagactttggccaagtagtacagtgtttgcaggagcagtaacaagatggtgataactttgaaaatacttctcaaaagaaaaataaaaaagaattagggaagttcagtctggagataattcagaaatacagatgataattgttttcaaattcttgaaggaaatgggagagagaataggctaattctgtattgcttcagaaaccaaatggaaacaattaaattccattagagaaacggttggaaaatatgaggaggatttagttcagtacgaggaagctgtttctaatactttttgttggttaaaaatacattccgctgctgtggaaagcctgtagctgccaggagtgttacagagggcattcctcccttgagttgacatttgtgccaaaccggcttttagggcttctccagcttttaagatgcgataatgataagatgatcatcgggaaaacatccctcagatgaaacgttcacaggctggctctgaaaactggcattcagatgattgcggctcccccatactgtaggaatattgtttatggcttaaggttgcctcgctcctcatctgtaatcagtgaaagtttatccagaggttaattaccggttttctggtgggtatctgggaactgaggatgggagattaactgttgtatatgaccatagtaaagcaaaagactgttagagaatgagtaaacgttcgttttcctccctacagaatttacagttactctctgtccattccactcactactgtcttcatcacacacacagaggcaaacgtctgattcagatagccaggtgtgccatgcatgcactccaccatattgtgatctcttcgaggcttgtttctgtcccctgtcctccacagtcctggattgttaatgaatagttcatacatgtttgttaaataaatataccttctttaaaatta

SEQ ID NO: 20017 - DNA, 1007 bp, Homo sapiens
gggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacatacaa

SEQ ID NO: 20018 - DNA, 1017 bp, Homo sapiens
gaagagaggctcagagggctgaagtgcctatttggccgaaagccgtggcagagtggcaaggcagggccaggggaagcggctccgccgccggggccgggcccctgtttggccggtgcccggtccttagcctgaaggtggcgggcttccgccagaagcccctggcggaagcggtgcccgcgtgcgggccagagtgtgggtgtgcaggtctctgggcggcccaaagggggtgcccctgcctggtaacctagcgggagggtggggacggcggggagggcggcgggcgcggggcacggctccgctgctcagggcaggctccgcccccaggggcgcggatttaaaaggatcgaaggcagccccggagcccagcggccgggaagcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatccccattggggacagctccccacacctccctgagggaccagcgactgcagctgagtcatgatctgctcggaatcctcctgctaaagaaggctctgggcgtgagcctcagccgccccgcaccccaaatccaggaggctgctggtacaaatactgcagaaatgacaccaataatggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctctttacatacaa

SEQ ID NO: 20019 - DNA, 1354 bp, Homo sapiens
gtgctgtgaggcttgccccgcggacagtaaacttgcaggggcgagagggagggacatcgattaaacctaaatcgtgggcgttcagtcctcagggcaccggagcgcgtgaaaactccagcggactctgctggaaaggagatcatgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcactgtgattttggccattcaactcactacctggagagaacttagtaa

SEQ ID NO: 20020 - DNA, 3298 bp, Homo sapiens
ggcgttcccggccggacaggcggggcgtcggggcgcgggctggggccgctgtcagtcagtccactggctcccgcgccgcgtctgtgtccgtcgctcggagggtggaagccggggtctcgcgggccgcgggccgcatgactcctctctgcctcaattgctctgtcctccctggagacctgtacccagggggtgcaaggaaccccatggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctgagtggagccttaaagtggcttcacctggaggggccagagggtcacctggagctggggagacacatctgccttcctctgcagggatgccttcacgtactgtccctagttcagcctagaaattctgaccagcacctcagtttccctcagagggaaacagcaggaggagggatccctgactgctgaggactcacactgaccagacgccacaccttgtgcttcttatctgtccactgccactcccccagttcaaatccttaccctgcagaaatatcacagttagctggggctcagcagtcctccctctggggactccctgccaccactgccagtttctgaaacggtcccactgggtcctcactgtccttcccagttcctgttcaggttctggcaggggcccagggatccaggggacctggttccaatctcagccctgctgtcaccaccttgtcatgcaccatcaagcatatcagtctacctttctttttttctgagacagagtctcactctgtcgcccaggctagagtgcagtggcgcgattttggctcactgcaacctccgcctccggggttcaagcgattctcctgcctcagcctcccgagtagctgggactacaggtgagccccagcatgcccagctaattttttttaatttttagtagagacggggtttcaccatgttggccaggctggtctcaaactcttgacctcaggtgatccgccgacctcggcctcccaaagtcctcggattacaggcatgagccaccacacccggccaatcagtccacctttctaggccttggttccttgcctgaaaaatgaaagaggcgctggctttccacagtgtcatgctttggcactttagctatggttttctttctgtgtgtgtgtaagccactgcttataataaaaccaacaataccctcagactgaaagggcggaagttattatctgcatctttatcaaccccaagccccacttcctccctgacctccccatgccctccccagcctctcccagcacaagtggggcaaagccagcatgcaagcagaccccaccaccacagcccacctccgtcctcacatacgtgcaggctggctcgggagtccagtgagcagagcattggacttggctggccagagggtctctgagggcaagagacatggccaaccaagggcaaggagtgaccctgtggagggttctgccgaactcaatgcagtgagaagagggacagggacaagtagtccttgaaactgagccccattctgaatccctgcaggccaagtcattgctcagccaggactcagttcatggaggaaacttgtcctgctgcagtccctgagtcttgtcctcctgagaggaagccctggcttccaaggctgggagctggaggatgaccttcggtcggtctgtctgggttctccctgcagacagcttcctagctcatgcccatagctcatgctccctgccgagaaagtggaggacgtggtacagggttgcagatgtttagttttaaaaattcaattataaaaataataaatgctcatgatagaaaatttggaaagtgcaaataagcaaaaatgaaaacaattttaaaaatgtaaaacctctcttgccagggaatgggggaagggcaagtgaggagttctttaatgggtgaagagtttcagttttgcaaaatgaaaaagttctggagatcagttgtgcaacaatatgaatatacataacaatactgaactatacactgaaatggttaagatggtacattttatgttatgtgtattttaccacaatttttataaaaagaggattaaatctaaaggaaagaaaaaattaaaaccacccataactttactctgaagcagtaacagtggcatgtttcctccta

SEQ ID NO: 20021 - DNA, 2073 bp, Homo sapiens
aacctggagggtgaaacactcactctctcccagccttccttacgaagcctgtgactttcgtgactgctttctcttttttgttttccttttttcttttttttttttttttcctggctcagcttgaaacagagcctcgtaccaggggaggctcaggccttggattttaatgtcagggatggaaaaacttcagaatgcttcctggatctaccagcagaaactagaagatccattccagaaacacctgaacagcaccgaggagtatctggccttcctctgcggacctcggcgcagccacttcttcctccccgtgtctgtggtgtatgtgccaatttttgtggtgggggtcattggcaatgtcctggtgtgcctggtgattctgcagcaccaggctatgaagacgcccaccaactactacctcttcagcctggcggtctctgacctcctggtcctgctccttggaatgcccctggaggtctatgagatgtggcgcaactaccctttcttgttcgggcccgtgggctgctacttcaagacggccctctttgagaccgtgtgcttcgcctccatcctcagcatcaccaccgtcagcgtggagcgctacgtggccatcctacacccgttccgcgccaaactgcagagcacccggcgccgggccctcaggatcctcggcatcgtctggggcttctccgtgctcttctccctgcccaacaccagcatccatggcatcaagttccactacttccccaatgggtccctggtcccaggttcggccacctgtacggtcatcaagcccatgtggatctacaatttcatcatccaggtcacctccttcctattctacctcctccccatgactgtcatcagtgtcctctactacctcatggcactcagactaaagaaagacaaatctcttgaggcagatgaagggaatgcaaatattcaaagaccctgcagaaaatcagtcaacaagatgctgtttgtcttggtcttagtgtttgctatctgttgggccccgttccacattgaccgactcttcttcagctttgtggaggagtggagtgaatccctggctgctgtgttcaacctcgtccatgtggtgtcaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccagcagccctctctagtgaacagatgtcaagaacaaactatcaaagcttccactttaacaaaacctgaattctttcagagctgactctcctctatgcctcaaaacttcagagaggaacatcccataatgtatgccttctcatatgatattagagaggtagaatggctcttacaactcatgtacccattgctagtttttttttttttaataaacgtgaaaactgagagttagatctggtttcaaaacccaagactgcctgatttttagttatctttccactatcctaactgcctcatgccccttcactagttcatgccaagaacgtgactggaaaggcatggcacctataccttgattaatttccattaatggaaatggttcgtcctgagtcatctacgttccgagtcaggctgtcactcctactaccaatggccactgtgagccacagaaggaagacatgtacgtgctgttctactttatatgatgtgagaagccaacatcagtgtcccttggcagcagtctacaggcataacttgttttattgtgctgaattttattgtgcttctcaaatattgcacttttaaaaaaattgaaagtttgtggcaatgctgttgagcaaatctgctggcatctttcttcccaaaggcatgtgctcacttcatgtctctgtatcaattgtcataattttcgcaataaacttgattattattatatgtgcttatggtga

SEQ ID NO: 20022 - DNA, 13014 bp, Homo sapiens
ggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactg

SEQ ID NO: 20023 - DNA, 13091 bp, Homo sapiens
cacgggactgacaggcaggcaggccgcgggctgggatccggacaccaaagcaaaagcaccgctgggcgccggaggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttgggtctatgagcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtc

SEQ ID NO: 20024 - DNA, 12999 bp, Homo sapiens
ggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttgggtctatgagcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactg

SEQ ID NO: 20025 - DNA, 12843 bp, Homo sapiens
ggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactg

SEQ ID NO: 20026 - DNA, 5353 bp, Homo sapiens
ggagaaaagggagcggagggcaggcgagggttaggtttccgaccctccgcgtggcccacagctcataccttttcgggtgtccccgggtgtcaggcgagagcggtcctggggggcgctgggtgcccacccggtgaatggccgcctgagccggggaagatgcttcatctgcccctgcccagatccggaagaacggtgaatttcccccgcagctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcagcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggtagcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagacgacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctactttttt

SEQ ID NO: 20027 - DNA, 13075 bp, Homo sapiens
ggagccgcggggcttccatccttcctttgactgatttttaaattttaatttgtattttccccgccgccccgccccttttcctccgaccccgccctatcgctccccggcttccctgctctttcctttttcccggcttccttcctcgcgtttctttcccctgcgccctcggcttgcctctctccctcctccctcgctctctcccccttctctccccttcttcctcggtttcttccgtcctctctctccccctcctcctcccccgcctcctcctcctgcgctcccgccccctgccccctccccccgtgcctgcagacgcgcggatcgtccatgcgctcctcgcgggcagaatgctgggcagcagcgtcaagagcgtgcagcccgaggtggagctgagcagcggcggcggcgacgagggcgcggacgaaccgcggggcgccggcaggaaggcggcagcggcggacggcagaggcatgctgcccaagcgcgccaaggcgcccggcggcggcggcggcatggccaaggccagcgcggctgagctgaaggtcttcaagtccggcagcgtggacagccgtgtccccggcgggccgcccgcctccaacctgcgcaagcagaagtcactcaccaacctctcttttctcacggactccgagaaaaagctgcagctttatgagcccgaatggagcgacgatatggccaaggcgcccaaaggcttaggcaaggtggggtccaagggccgtgaagctccgctgatgtccaagacgctgtccaagtcggagcactcgctcttccaggccaagggcagcccggcgggcggcgccaagacccccctggctccgctcgcgcccaacctgggaaagccgagccggatccctcgaggaccctatgcggaggtcaagccgctcagcaaggcgcctgaagcggccgtgagcgaagatggcaaatcggacgacgagctgctctccagcaaggccaaggcgcaaaagagctctgggcctgtcccctctgccaagggccaggaggagcgcgccttcctcaaggtggaccccgagctggtggtgaccgtgctgggagacctggagcagctgctcttcagccagatgctggacccagagtcccagagaaagaggacagtgcagaatgtcctggatctccggcagaacctggaagagaccatgtccagcctgcgagggtcccaggtgactcacagctccctggagatgacctgctacgacagcgatgatgccaacccacgcagcgtgtccagcctctccaaccgctcgtcccctctgtcatggcgctatggccagtccagtccgcggctgcaggctggtgacgcgccctctgtgggtgggagctgccgctcggaggggacgcccgcctggtacatgcacggcgaacgggcccactactcccacaccatgcccatgcgcagccccagcaagctcagccatatctcccgcctggagctggtcgaatccctggactcggatgaggtggacctcaagtccggctacatgagcgacagtgacctcatgggcaagaccatgacggaggatgatgacatcactaccggctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcacaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaagatggagtttcgttcttgtcacccaggctggagtgcactggcgcgatcttggctaactgcaaactctgcctcccaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttgggtaggtaaagcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactg

SEQ ID NO: 20028 - DNA, 11645 bp, Homo sapiens
ggagaaaagggagcggagggcaggcgagggttaggtttccgaccctccgcgtggcccacagctcataccttttcgggtgtccccgggtgtcaggcgagagcggtcctggggggcgctgggtgcccacccggtgaatggccgcctgagccggggaagatgcttcatctgcccctgcccagatccggaagaacggtgaatttcccccgcagctgggatgaaagcagctccatcagtagtggactcagcgatgcctcagacaatctcagttcagaagaattcaatgccagctcctcactcaactccctcccaagtactcccactgcttctcgcaggaactcaacaatagtgctacgcacagactcagagaagcgctcactggcagaaagtgggctgagctggtttagtgaatcagaggagaaagcccctaaaaaactggagtacgacagtggtagcctgaagatggaacctgggacttctaagtggcggagggagcggcctgagagctgtgatgattcatccaagggtggagaactgaaaaagcccatcagcctgggccaccctggttccctgaagaagggcaagaccccacctgtggctgtaacttcccccatcactcacacagcccagagtgccctcaaagtcgcaggcaaacctgagggcaaagctacagacaagggtaagcttgcagtgaagaatactgggctccaacgctcctcctctgatgctggtcgggaccgcctgagtgatgctaagaagcccccctcgggcattgctcgcccctccacttcgggatcctttggctacaagaagcctcctcctgccacaggcacagccactgtcatgcaaactggtggttcagccactctcagcaagatccagaagtcctcaggcatccctgtcaagccagtaaatgggcgcaagactagcttagatgtttccaacagtgcagagccaggattcctggctcctggagcccgttctaacatccagtaccgcagcctgccccggccagccaagtcaagttctatgagcgtgaccggcgggcggggtggacctcgccctgtgagcagcagcattgaccccagtctcctcagcaccaagcagggaggccttacgccttccagactgaaggagcctaccaaggtagccagtgggcggaccactccagcccctgtcaatcagacagatcgggaaaaggagaaggccaaagccaaggcagtggccttggactcagacaacatctccttgaagagtattggctccccagaaagtactcccaagaaccaagcaagccaccccacagccaccaagctggcagagctgccaccaacccctctcagggccacagcgaagagctttgtcaaaccaccctcactagccaatcttgacaaggtcaactccaacagtctggatctaccatcatccagtgataccacccatgcttcaaaggtcccagatctgcatgctacaagctcagcatctgggggccctctcccttcctgcttcacccccagtccggcacccatcctcaatattaactcagccagcttctcccagggcctggagctaatgagtggtttcagtgtgccaaaagagacccgcatgtaccccaaactctcaggcctgcacaggagcatggagtccctccagatgccaatgagcctccccagtgccttccccagcagtactcccgtccccaccccacctgctccccctgctgctcccacagaagaagagacggaagagctgacttggagtggaagccccagagctgggcaactggacagtaatcagcgggatcggaacactcttcccaagaaagggctcaggtaccagcttcagtcccaggaggagaccaaggagaggcgacattcccataccattggtgggctgcctgaatccgatgaccagtcagagctgccttctccccctgcacttcccatgtctctgagtgcaaagggccaacttaccaacatagtgagtcccactgcggccaccacgccaagaatcacccgctccaacagcatccccacccacgaggcggccttcgagctgtacagcggctcccaaatggggagcaccctgtccctggccgagagacccaagggaatgattcggtcaggatccttccgagaccccacggacgatgttcacggctcagtgctgtccctggcctccagtgcctcctccacctactcctcagctgaggagaggatgcaatctgagcaaatccggaagcttcgtagggaactggaatcatcccaggaaaaagtggccaccttgacgtctcagctttctgccaatgctaatctggtggctgcttttgagcagagcctggtgaatatgacatcccgcctgcgacacctggcagagacggccgaggagaaggacactgagctgctggatttgcgagaaaccatagactttctgaagaaaaagaactctgaggcccaggcagtcattcagggagcccttaatgcctcagaaaccacacccaaagaacttcggatcaagagacaaaactcctcagatagcatctcaagcctcaacagcatcactagccattccagcatcggcagcagcaaggatgctgatgcgaaaaagaagaaaaaaaagagttggcttcgaagttccttcaacaaagcgttcagtataaaaaaggggcccaagtcagcttcctcatactcggatatagaggagattgctacacccgactcttcagccccctcatcccccaaactacagcatggttctacagagactgcttcaccctccatcaagtcctccacctcgtcctccgtgggcactgatgtcaccgagggccctgctcacccagccccccacactaggctgttccatgcaaatgaggaggaggagccagagaagaaggaggtatcggagctgcgctctgagctatgggagaaggaaatgaagcttacagacatccgcttggaggccctcaactctgcccaccaactggatcagcttcgggagaccatgcacaacatgcagttggaggtggacctgctgaaagcagagaatgaccgactgaaggtagccccaggcccctcatcaggctccactccagggcaggtccctggatcatctgcattatcttccccacgccgctccctaggcctggcactcacccattccttcggccccagtcttgcagacacagacctgtcacccatggatggcatcagtacttgtggtccaaaggaggaagtgaccctccgggtggtggtgaggatgcccccgcagcacatcatcaaaggggacttgaagcagcaggaattcttcctgggctgtagcaaggtcagtggaaaagttgactggaagatgctggatgaagctgttttccaagtgttcaaggactatatttctaaaatggacccagcctctaccctgggactaagcactgagtccatccatggctacagcatcagccacgtgaaacgagtgttggatgcagagccccccgagatgcctccttgccgtcgaggtgtcaataacatatcagtctccctcaaaggtctgaaggagaaatgcgtcgacagcctggtgttcgagacgctgatccccaagccgatgatgcagcactacataagcctcctgctgaagcaccggcgcctcgtcctctcgggccccagcggcacgggcaagacctacctgaccaatcgcttggccgagtacctggtggagcgctctggccgtgaggtcacagagggcatcgtcagcaccttcaacatgcaccagcagtcttgcaaggatctgcaactgtatctttccaacctagccaaccagatagaccgggaaacaggaattggggatgtgcccctggtgattctattggatgacctgagtgaagcaggctccatcagtgagttggtcaatggggccctcacctgcaagtatcataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggtccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattgtcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctgtgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagtaaaaaaaaaaaaaaaaatctaatttgtatttccatgacaacgtgttctcccagcaacatccctctcctttatttgagttataaagggcactgctgggcctgagaaccaggccagaacctccttctgtatggcagctaacagtgtagggctccagtatcccaggaaggccccttatccacactccactcagctcataggagagtcttgcataatgaagacacagacctgggcacttcagtccttgtgctcctcctctcttttccccacagcaggacctggatacagaagtactcagccaaggtgacagaataaaatcctttttttgttgttttctgtttgtttgtttgttttggagaaggagtctcgctttgtcacccaggctggtgtgcagtggcacgatctcggctcactgcaacctccgcctcccaggttcaagcgattctcctgtctcagcctcctgagtagctgggattacagacgtgcgccatcacgcccagctaatttttgtatttttagtagatacggagttttgccttgttggccaggctgtgctggagctcctgacctcaggtgattcacctgccacagcctcccaaagtgctgggattacaggcgtgagccacagcaccctgccaaataagatcctttttaaaaaatatctgaaaaaagcttcatatctttacaaactcataaaatagctgattgggccatggaggagatgaggctgtttagaactggttttgtttcaagtttgtcaattttccctgtatgagaacttgggtaaagcacaaagaaacatacagtgctagtaacaggtctcctgcgccctggaactaagtgtttggaggaaggactaaaccccgggggaggtgagtataaaataattccactaagatcacctcctcagtccccagaaggctgatggtggatcctctggccatctcctgtggggtcttactgctcctctgccatttctctatgcctgaagacacgaagatgatatcaaggcagagctaccatatcgcagccagtctctaggctactgctgtgcagtggctcccactttctaatgcttttttgtttttgctttttctaacaaaacaatcttttttcaaaatgaattccaacccctgctagcttccttccccgcctccatactgttttaggcagcaccgtttatgtgacagagtccgtgtttctcaaatgcatggtgttcctcaggtggagagtgggcagaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtc

SEQ ID NO: 20029 - DNA, 7839 bp, Homo sapiens
ggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20030 - DNA, 10960 bp, Homo sapiens
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20031 - DNA, 11000 bp, Homo sapiens
gttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20032 - DNA, 7882 bp, Homo sapiens
taaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaa

SEQ ID NO: 20033 - DNA, 10594 bp, Homo sapiens
atgagcgtgatgctgtggcgctgggaacagaataacaccaccatgaagctgcaaatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20034 - DNA, 5084 bp, Homo sapiens
aatcttttcaatcgaatgctttgccttcagacgtcaatggaatgagctaagaaatgttatagtcaatgatttttgcatcattaaaagtagcacttagggctggaaagactttctgcaatgtttctgtgcagtctgtgaggatttaaagtagtttttcattcttagattttcttcaatttgacccgctgttgcaaactcccctgggaccacatggagggcccttccattcagtgctttacgggccgcaatgtagtgaaatgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaa

SEQ ID NO: 20035 - DNA, 7777 bp, Homo sapiens
atgctctggcctaggaaccttacaagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20036 - DNA, 10600 bp, Homo sapiens
atggctattgatctctactgcggtttggcttgtctgtggggaatacatgagccccgacaaatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagtgcatcatccaaggactcatctcaaagcaaaatcatccgcttcactctgggtcagaaaaagatctctagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagaatcatgggagaaaagttctgtggacaactttgtcagccgtcttcacagctcacttcatttctctcttcctttgttccatcacgcaaggtatgagttagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20037 - DNA, 10667 bp, Homo sapiens
tctcatgatgccggcagcagtcaccctcattgcaaaggcagtggtgccgagtgaggttcccgagtggattttaagaagacaggaagacctttgaagaggtggtgctgatttccttggctggcgggaactctgtctggctgttgcatgcatcacttttgtgtgggttattttgttcctctgtggatttggaagcatcgctgaaggagagagaggattttatttctgggaaatggaatcggtttctgagtccagccaacagcagaagagaaagccagttatccacggactggaagatcaaaagaggatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattc

SEQ ID NO: 20038 - DNA, 9758 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaggcgggtggatcacttgagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaa

SEQ ID NO: 20039 - DNA, 9227 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaggcgggtggatcacttgagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaa

SEQ ID NO: 20040 - DNA, 9695 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagcaattcaaaaaccaaacattcagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactggctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaa

SEQ ID NO: 20041 - DNA, 9821 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgtcaccccttgtctggccaccaaagaaacgacaaaatggccctgtgatctacaagcatagatctcggatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcagaagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattga

SEQ ID NO: 20042 - DNA, 7386 bp, Homo sapiens
agatgcagggaagttttgcctcttcctgaaaattatattattagctttttaaaaatcaggatgactgctagttttgtttaaagtatttgttctggaaatactaaagttggagtctaccagactgaggttagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttactgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaagaccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcagtttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgt

SEQ ID NO: 20043 - DNA, 1226 bp, Homo sapiens
agcatttagactcccactcacttctgacgcacatgagcttctttttagctcaaaaagtagagttagctacattatagctctcatcctagtagacctcctaacacctttgatcatgaaaaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtag

SEQ ID NO: 20044 - DNA, 4991 bp, Homo sapiens
ccggcccggcccgcccggcccagccgctcctgctgggcgccccaaccgggtccggcccgggggggcgggggccgcggccgccgaggatggggaaatccaacagcaagttgaagcccgaagttgtggaggagctgaccaggaagacctactttaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagcggtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcttcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctcttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgcctcgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggggccagggtcagggcgaggcccaggggtggacaggggccgtgtagcatgccccagcctccccaagctcctgctgtatgtcgtccatgtcacgccaattaaacacgcttcctggacttgtcctcgcc

SEQ ID NO: 20045 - DNA, 4860 bp, Homo sapiens
gattgagagatggcaacgattaccgagaaggaggtccagcagtggtacaaaggcttcatcaaggactgccccagtgggcagctggatgcggcaggcttccagaagatctacaagcaattcttcccgttcggagaccccaccaagtttgccacatttgttttcaacgtctttgatgaaaacaaggacgggcgaattgagttctccgagttcatccaggcgctgtcggtgacctcacggggaaccctggatgagaagctacggtgggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgcttttgttttttattttgaacagacgttttaaaagaaaaaaaaacaactaccttctgtcctagaagacacagactgacagatggggtgaaggcctggggacctcagagaactctgccttgccctcgtccctcgtccttcggcagccggagaggctgtgggtgggccgagggtgtctaggggttctgcctggtcaacgttatttgtcgtcccatcttttggcagcaaaaccacctgcgtggctaggatgattaattatgaggatgatgattttttttgtgataacagtattgtgctttttgtggggaaagtgaggtttttttttatatacatatataattgatatctttaatttattggttgttaactgttgctgctgcctggtgtgtcctcagctcccagggctgcgggcccaccgtttacatgtgcacgccctgacccacctgcccacgccgacttgggaggatggtggcctgcagcggccaagaagccaaaaaaaattttttttttttcagatactgtgcttgatttttggagaggggagaggtggaaattcctaaatggctaatgcactgttccctccagcccgaatgcctcctgccaaaccccttttccctgctgcctctgtccccgcatccttgttctcccctgggtccgtaacattttttccgaggatgaacaggggacatctttaggtttctcaactcttgctttggtgtttgccgcagcatggaaaacagggcgcctaaggctgggagctggaagaaggggcattgggtacccaggcagagtcaggagaggtggtctttgaagtaagttagcagaaatcaaggggacccccgcctccttgggctggggaggggatttcaagatagttcatgactctctcccgctctgccttccctccttcctatctgctttttccagtaaactgcatggtgtccttccctggccttctcttggctcaaaggctgggagggagggaaggagagaagagttccaggcaatcccatcaatatagtccctacacctggggctgcggcccacatgtcttcacggaggcttccagcggtgcctgccactgaggcaggtgcggccccaggaccatcaccaggaatgcgaggccaccctggaccagaggtaggagcccaaggtccggcccttgctctttgattgtgggcagcctcctgccctctctgggtctcagttgccccatctgcagagcgaggaggcccgggctggttggtcttgaaggcccttttccatgccgacatcatgtcactctaggcctggggttcagtttcctgtggctggtgatgctgtggttaagtttgcttgaccccagcagcccgagggactgtctgagtcacagcacagcccctattgcgtggctgctggtgtgtggggtcagttccagcagatgaatgtgtcatgtggcacaccttgtcccttcccgcagcatttcctggttccccccagacccttgagcgctctttgggacccagaaggagtccttgcacagggaaggcttgaggtgagaagccgcttcccagactgtcagggccaggcctgggtctagaattcttgctgctgctttgcagagtcaacagcccatcagcccatgttttagaggggacactttggtcctcggttcccaccctcagcaagcaggcctccagcccgaggaaggcctctgccgtagtgacgttgccgtgtggggctgcgtggctgttccccttggctggagcattcagccaaccccagcgtcccccctgaggcgttcattggcagccccctaggactgcacgctggccccacggtaaccccccctcccccaccaacatcctgcagggatggggtcagtggttccaccttcacaggccactttgaagggtggattctttgaggcccctgccagtcggctccctgctcagctgctggcccgggcgacctgggactcagcaccaacggctgaagtttctcagctgggctctgacctggggtctggggcagggaacgaacatggtggctttgggctgagaggatgagggaggtctttcccaggtcaaattactttcctttggcctctgcctgaggctcgatttgcctctctggtccaatgggactgacactgttgtacaacctgacctgtggctgagggtgtctgggcttaagcatgtggaccccttcggtgtgtccggccttcctccatcgtcctgccctttggccttttggtttgaagccacaggtgtggcttctggccttagcagatggtatgcttgcggaccgcagcccagcatgccggtgggcccacagcccgagccagcccagagctgccggaagggccgcccttcccggccctggcggggtgctggacactggccattttcactagagtttgcctggcagggaccgatctctgccccctcctctccccaggcctctggctgcagtgatgccgcagaatcctgagccaggtgcctcctgagcagcccgtgcgcctctccacagcggcgtttgccacccaatgcggctcgcttcagatgctctgatgcagagggcacgcccatagtccctctgcagagcctcgcactggggccagggcaggcaccagccccaggcggccagtcggccacggcctgtcctcttcctcgtagcgtctgctcctcactttgtgttgatggtgacttaggagaatgttccgattttccatgatctaagcaggccacgtttaaaataacatcaaggcaagcgtacgtgtcaccctctgtactgacatctcttcccctgaaatgcttttcagtttgacagcccgtttcctagacaagtgcacctggggtttcaggaactttgtgttttttcggagggggttggtggggaggtcgggatgcctgggatcccttcctggagaggcaggctgtctctggaaaaagcctccattgcccacccgccaggcggaaagtcaccctgttcccagcgcggtttcagcatttaattttaagggagctaaggaagcgcggcgcgccccctggtggtggtaagccgccaacgcacctgggggctgcaaccccaccggacgggtggtccggagggaggctggagcggggaggcgaggagggggctgtgagtcctcagaggccctgggccaccacatttctggcagcgtttcccagacacccctctgctaggccatccctggatagcaagtgaattaacttaagggcactgtgatgggaagccttgcccccctcttttttttttttttttaatatctgcggaataaacccaatggttaatttttgaatgaataaaaggcttttgttgaataaacagctggtcccatcttctgtcttggcatcttagcatccaggctcaggctctgccccttctccaggatggggtagccccgagtcgccctccccagtctgcacattccctgttgtccctgttcctgcagtggctcccggccccagggaggcccacctcactcccagcctgactcggtggctggcttccttcaggactttgcgcaagtcagttctgctcattgggtctcaatttccccatcccttggatgggagcaagagtctctgctgggcctgcctcgcaggggcctggtgagacccaaatgtgagtgtcatcatcaaagcccctcacagaagtggaggacggtgcccaagagtagcggtttggactgctgctgcctcccacccggagcctgccacttgggggagaaattggtataatgcttgcaaaaacaaacaaacaaaaggcaatgtcttctggttgtggttatttcctttcctgcttgcctccccagccccctttgagtctctttttggggtgccgtcctgtctgaacctgccggtgtgtgtctctggggccagggtcagggcgaggcccaggggtggacaggggccgtgtagcatgccccagcctccccaagctcctgctgtatgtcgtccatgtcacgccaattaaacacgcttcctggacttgtcctcgcc

SEQ ID NO: 20046 - DNA, 6228 bp, Homo sapiens
agccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaaca

SEQ ID NO: 20047 - DNA, 4182 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcaaaaatctactgaagtaatggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacaggctgttttcatttgtttcttctgcatccttttaa

SEQ ID NO: 20048 - DNA, 5782 bp, Homo sapiens
cgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcaca

SEQ ID NO: 20049 - DNA, 6659 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 20050 - DNA, 6671 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcaaaaatctactgaagtaatggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagttcattgaaaaatgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 20051 - DNA, 6287 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcaaaaatctactgaagtaatggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 20052 - DNA, 1594 bp, Homo sapiens
gattttccatgggcaggagccagaggacgggctggaccattgcttcgtcctcctctaacagaatctacactagagacgatttgtggctaatggtgcagtttaacttaaaacttctgaggagaacccccatcttcagttatcgtagttcatgacctcccagcagtatgaggatttattaactcatgtctctttaatttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaat

SEQ ID NO: 20053 - DNA, 562 bp, Homo sapiens
acacgcgctcgcaggctgacggaggttggcggtggggcggccgctcaggaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgg

SEQ ID NO: 20054 - DNA, 583 bp, Homo sapiens
atttgcaaaggaaacattgaggctgacgagaggagagttggagactgcagaacttgggagctgtccactgctctgcctttgtcacagcccagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaaggg

SEQ ID NO: 20055 - DNA, 3915 bp, Homo sapiens
atgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctgagacctatgccaatatcagttgggaatatgagggaccagagcatgtgaacttttatgttgaatatggtgtagcaggcagcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaa

SEQ ID NO: 20056 - DNA, 2687 bp, Homo sapiens
aacagatttctaaaaaatactgaaaatggcaacagccttgcaaggacagtttagcctctaaaagcagttcctttgaagagaaaatactcaattagatgtatacattctgttctgtttaaaactcagttttgtatttttctcattatacttaatgtaaaatgtatcctgttaacagtgaatactttaattggtttgggaatttgtttttattgagaatatatagtgaaaataactgtgaacacagtgttcaccaggggtttttagcatttaatgtgatgattattcagatttctctacttgaattttttaatgaatgaagatttttcaaagttaattattcatataattcctgattaataattgacagatcctaatttggggccacatgtaaaatatatgaaagctcacataacgtggcaattttttactctgagagactgcagcagttcccatctccccttaacctattgccaccaacaccattgatttgttttccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctc

SEQ ID NO: 20057 - DNA, 595 bp, Homo sapiens
actttgtttaaaatttccctttgctactgggaggaaatggaaagcagtaagataacttcatttgtaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaa

SEQ ID NO: 20058 - DNA, 3025 bp, Homo sapiens
agacgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagacaagtactgcctctttttaaaatattaggtttgagtccatctaaaggcaaagtcattatgtgttttgagaggatggttttattaaatataaatgtaaatgacaagagagaaaaaggaagagaataactaaatgggtgcctgtcacaggtttgtactaatgtattttcagctgaatcaggaatgagttactgaaactcaaaaccttgaatcgtgcgagcacggtgaaatgtcaatttaatacatgttgaaacattc

SEQ ID NO: 20059 - DNA, 726 bp, Homo sapiens
attgtattgccacaaagccaggctgatcaccctgggaggcctgggaggtctgagcagctttggattggctgtcaggagcaggactttaacattttactgcacatgggccagccacagcagggttcaattgccagtgcttttatctgcagaaatgtgctgggatgggcactttgtttaaaatttccctttgctactgggaggaaatggaaagcagtaagataacttcatttgtaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaaggg

SEQ ID NO: 20060 - DNA, 6380 bp, Homo sapiens
cgcgcgggcgcgggggacggcgcaggggccgcctggctggagcagccagaggggatagcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgacaaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcaaaaatctactgaagtaatggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaacgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 20061 - DNA, 5577 bp, Homo sapiens
gccatgtgaggacacagagagaaggcagccatctgcaagccaggaatagagccctcaccagagacctaatttgccagcatcttgatcatgtacttccagcctccagaactgtgagaaaatgcatttctgttgttaagccacccaatctgtggattttgttatggaagcccgagcaaactaatacaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttcccc

SEQ ID NO: 20062 - DNA, 5809 bp, Homo sapiens
gaagaggaggaggggaggcaaaaacaccgaaaaacaaaaagagagaaacaacacccaacaactggggtggggggaagaaagaaagaaaagaaacccacccacccaccaaaaaaaaaaaaaaaaaaaaaaaaaaaaaaaaatcctgtggcgcgccgcctggttcccgggaagactcgccagcaccagggggtgggggagtgcgagctgaaagctgctggagagtgagcagccctagcagggatggacatgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagcaaaaccatttgaaaatggacaatatttggacatttatggaattacaagggaccaggctggggaatatgaatgcagtgcggaaaatgatgtgtcattcccagatgtgaggaaagtaaaagttgttgtcaactttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataaattcaaagacccataaaaggcttttaaggattctctgaaagtgctgatggctggatccaatctggtacagtttgttaaaagcagcgtgggatataatcagcagtgcttacatggggatgatcgccttctgtagaattgctcattatgtaaatactttaattctactcttttttgattagctacattaccttgtgaagcagtacacattgtcctttttttaagacgtgaaagctctgaaattacttttagaggatattaattgtgatttcatgtttgtaatctacaacttttcaaaagcattcagtcatggtctgctaggttgcaggctgtagtttacaaaaacgaatattgcagtgaatatgtgattctttaaggctgcaatacaagcattcagttccctgtttcaataagagtcaatccacatttacaaagatgcatttttttcttttttgataaaaaagcaaataatattgccttcagattatttcttcaaaatataacacatatctagatttttctgctcgcatgatattcaggtttcaggaatgagccttgtaatataactggctgtgcagctctgcttctctttcctgtaagttcagcatgggtgtgccttcatacaataatatttttctctttgtctccaactaatataaaatgttttgctaaatcttacaatttgaaagtaaaaataaaccagagtgatcaagttaaaccatacactatctctaagtaacgaaggagctattggactgtaaaaatctcttcctgcactgacaatggggtttgagaattttgccccacactaactcagttcttgtgatgagagacaatttaataacagtatagtaaatataccatatgatttctttagttgtagctaaatgttagatccaccgtgggaaatcattccctttaaaatgacagcacagtccactcaaaggattgcctagcaatacagcatcttttcctttcactagtccaagccaaaaattttaagatgatttgtcagaaagggcacaaagtcctatcacctaatattacaagagttggtaagcgctcatcattaattttattttgtggcagctaagttagtatgacagaggcagtgctcctgtggacaggagcattttgcatattttccatctgaaagtatcactcagttgatagtctggaatgcatgttatatattttaaaacttccaaaatatattataacaaacattctatatcggtatgtagcagaccaatctctaaaatagctaattcttcaataaaatctttctatatagccatttcagtgcaaacaagtaaaatcaaaaaagaccatcctttatttttccttacatgatatatgtaagatgcgatcaaataaagacaaaacaccagtgatgagaatatcttaagataagtaattatcaaattattgtgaatgttaaattatttctactataaagaagcaaaactacatttttgaaggaaaatgctgttactctaacattaatttacaggaatagtttgatggtttcactctttactaaagaaaggccatcaccttgaaagccattttacaggtttgatgaagttaccaatttcagtacacctaaatttctacaaatagtccccttttacaagttgtaacaacaaagaccctataataaaattagatacaagaaattttgcagtggttatacatatttgagatatctagtatgttgccctagcagggatggcttaaaaactgtgattttttttcttcaagtaaaacttagtcccaaagtacatcataaatcaattttaattagaaaaatgaatcttaaatgaggggacataagtatactctttccacaaaatggcaataataaggcataaagctagtaaatctactaactgtaataaatgtatgacattattttgattgatacattaaaaaagagtttttagaacaaatatggcatttaactttattatttatttgcttttaagaaatattctttgtggaattgttgaataaactataaaatattattttgtattgcagctttaaagtggcacactccataataatctacttactagaaatagtggtgctaccacaaaaaatgttaaccatcagtaccattgtttgggagaaagaaacagatcaagaatgcatattattcagtgaccgctttcctagagttaaaatacctcctctttgtaaggtttgtaggtaaattgaggtataaactatggatgaaccaaataattagttcaaagtgttgtcatgattccaaatttgtggagtctggtgtttttaccatagaatgtgacagaagtacagtcatagctcagtagctatatgtatttgcctttatgttagaagagactttcttgagtgacatttttaaatagaggaggtattcactatgtttttctgtatcacagcagcattcctagtccttaggccctcggacagagtgaaatcatgagtatttatgagttcaatattgtcaaataaggctacagtatttgcttttttgtgtgaatgtattgcatataatgttcaagtagatgattttacatttatggacatataaaatgtctgattaccccattttatcagtcctgactgtacaagattgttgcaatttcagaatagcagttttataaattgatttatcttttaatctataacaatttgtgttagctgttcatttcaggattatattttctacaagttccacttgtgggactccttttgttgcccctatttttttttaaagaaggaagaaagaaaaataagtagcagtttaaaaatgagaatggagagaaaagaaaaagaatgaaaaggaaaggcagtaaagagggaaaaaaaggaaggatggaaggaatgaaggaaggaagggaggaaggggagaaggtaggaagaaagaaaggatgagagggaaggaagaatcagagtattagggtagttaacttacacatttgcattcttagtttaactgcaagtggtgtaactacgtttttcaatgatcgcatttgaaacataagtcctattataccattaagttcctattatgcagcaattatataataaaaagtactgcccaagttatagtaatgtgggtgtttttgagacactaaaagatttgagagggagaatttcaaacttaaagccacttttggggggtttataacttaactgaaaaattaatgcttcatcataacatttaagctatatctagaaagtagactggagaactgagaaaattacccaggtaattcagggaaaaaaaaaaatatatatatatataaatacccctacatttgaagtcagaaaactctgaaaaactgaattatcaaagtcaatcatctataatgatcaaatttactgaacaattgttaatttatccattgtgcttagctttgtgacacagccaaaagttacctatttaatcttttcaataaaaattgttttttgaaatccagaaatgatttaaaaagaggtcaggtttttaactatttattgaagtatgtggatgtacagtatttcaatagatatgaatatgaataaatggtatgccttaagattctttgaatatgtatttactttaaagactggaaaaagctcttcctgtcttttagtaaaacatccatatttcataacctgatgtaaaatatgttgtactgtttccaataggtgaatataaactcagtttatcaattaaaatatgtatttgactcattttaaaactctattagcttaagagaaagaaggaagaaataataatttgaagatatttctgctattctctttatttcctgtattacactcatctttctgcttactctaaagcagtacagggtaaaaattctagatgctacagtttcaaatgactccacactatattctttcttgctgttgctgattcctaaaaggtttgatgagctgaactacatctaaactaaaaataaattttctggaaacattttattattaattatttagaacctttacctggtaaaatacagcagagttagcaacagagactaaatatcctgttgataaaatcctgatgatcttacaggctaaacaactgaaaactcaaacgcttgtaagagccaggcagagtgtaatttcttaacagctgggtataaaacaacgggcacctgaaggtattcagatacaatttccttaaaaataccttggtttccaagcaaaacacgttatttggctgagaacctttagtttgtaaataccaaaccataatatacaaatgagatctcaagccaaatgaattttttaagccctctttcccatatctgttcatctatgatagtcaactgaataaatgagaacaatgtgatagataaaacaacaaagcataaaaaagattcatgcttggttttataagctattttgaaatataagtatcattgctattctgagaaatctatatacaccaaagccctccctccacaaaaaaactggaaatgttctaataaatgtctgatttccccca

SEQ ID NO: 20063 - DNA, 927 bp, Homo sapiens
atgatgctgttggtgcagggtgcttgttgctcgaaccagtggctggcggcggtgctcctcagcctgtgctgcctgctaccctcctgcctcccggctggacagagtgtggacttcccctgggcggccgtggacaacatgatggtcagaaaaggggacacggcggtgcttaggtgttatttggaagatggagcttcaaagggtgcctggctgaaccggtcaagtattatttttgcgggaggtgataagtggtcagtggatcctcgagtttcaatttcaacattgaataaaagggactacagcctccagatacagaatgtagatgtgacagatgatggcccatacacgtgttctgttcagactcaacatacacccagaacaatgcaggtgcatctaactgtgcaagttcctcctaagatatatgacatctcaaatgatatgaccgtcaatgaaggaaccaacgtcactcttacttgtttggccactgggaaaccagagccttccatttcttggcgacacatctccccatcagttgctcctactattcaggaaattaaatctggcaccgtgacccccggacgcagtggcctgataagatgtgaaggtgcaggtgtgccgcctccagcctttgaatggtacaaaggagagaagaagctcttcaatggccaacaaggaattattattcaaaattttagcacaagatccattctcactgttaccaacgtgacacaggagcacttcggcaattatacctgtgtggctgccaacaagctaggcacaaccaatgcgagcctgcctcttaaccctccaagtacagcccagtatggaattaccgggagcgctgatgttcttttctcctgctggtaccttgtgttgacactgtcctctttcaccagcatattctacctgaagaatgccattctacaataa

SEQ ID NO: 20064 - DNA, 3215 bp, Homo sapiens
aggtctaaaggtcgggaatgcttaccagtgaagcttttccaggacaggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaatgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggcttggggtgcccggccctcatccctgcccacgcagtgagtgctcatgtgtcttggccccttgctcgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtcta

SEQ ID NO: 20065 - DNA, 2286 bp, Homo sapiens
ggagtgctcggcagcggtggcggcggcggctgcagctccggtcgagccgcgcgcgctgcgaccccgctccgcagcccgctagtcgcccccgacccagcccagggccccggcgtggcccccgacccggcccccgcacccgccccgccgccgaccctatggagctgctggccgctgccttcagcgccgcctgcgccgtggaccacgacagttccacctcggaaagcgacgcgcgcgactcggcggcgggacacctgcccggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggcttggggtgcccggccctcatccctgcccacgcagtgagtgctcatgtgtcttggccccttgctcgcaaactggataaagggtgcccaagcctctcctgatgcatttgtaaacaagaaggtttcagcagtattacaccacctccctcatgcctccgagggg

SEQ ID NO: 20066 - DNA, 1022 bp, Homo sapiens
ggagtgctcggcagcggtggcggcggcggctgcagctccggtcgagccgcgcgcgctgcgaccccgctccgcagcccgctagtcgcccccgacccagcccagggccccggcgtggcccccgacccggcccccgcacccgccccgccgccgaccctatggagctgctggccgctgccttcagcgccgcctgcgccgtggaccacgacagttccacctcggaaagcgacgcgcgcgactcggcggcgggacacctgcccggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggtgaggacgggggggacagccacctccctcagggcccttcttcatccccagggcacatgcttgagacactgatgacaagtgctcgatactggcttctctacttccagatgtttggaatgttccataataaaatataaataaatgaagaactaaa

SEQ ID NO: 20067 - DNA, 1494 bp, Homo sapiens
aaaaaaacaacccaaatcaggctggaatgcacggcccagaggtccacggcgaaccctggatcataaggagaccgtgccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggc

SEQ ID NO: 20068 - DNA, 2513 bp, Homo sapiens
aggtctaaaggtcgggaatgcttaccagtgaagcttttccaggacaggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaatgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcccgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacattgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtgggggggggggggctctgggaagcacaggccagcacctccccaggtggcaggatctggcttggggtgcccggccctcatccctgcccacgcagtgagtgctcatgtgtcttggccccttgctcgcaaactggataaagggtgcccaagcctctcctgatgcatttgtaaacaa

SEQ ID NO: 20069 - DNA, 1341 bp, Homo sapiens
aatgggagtcatggcagccatggtggtcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggactcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgc

SEQ ID NO: 20070 - DNA, 2042 bp, Homo sapiens
tcatccaggcccccccccccccagctccttgctgggaccctgagccctgcacggatctcagtttccctagaaggtctcccgagggcactaagcgttgcccctggccccctcccgctgcaggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaggacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgc

SEQ ID NO: 20071 - DNA, 4007 bp, Homo sapiens
tttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaatt

SEQ ID NO: 20072 - DNA, 2725 bp, Homo sapiens
ggatgtatgcgtatggttttgttgggagatgtgcccctttcccagccgaggagggacgcacctttgacctttctgaagagctgggcaggtcggtaaccagggaagggacaggcaccacccggctaaattcagaaccagtcccgctcctctgcttgccactccttaattgctcaaggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggg

SEQ ID NO: 20073 - DNA, 838 bp, Homo sapiens
acgccccccacccgggaggggggagagaggcaaaaagtaagagaggaaaaaaaatagcaggaagatggcgcccaccaagcccagctttcagcaggatccttccaggcgagaacgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtag

SEQ ID NO: 20074 - DNA, 5847 bp, Homo sapiens
ccgcccgcccacgccccccacccgggaggggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgtgtaaagatatgtttattttttgccttcagagggtcagacgaccagttgcctgccgttttgtcttcttctaaggtgtgtgttgggttgttttgctttcctttgcatctttattaagatgtctttcatgtgtatatgcctctgccatagaatactcagtcttgtggtcaagagagttctcaagtgacaaccattggggtttcttcataaagatcttgatatgatcaagatggaaagagacaagcataaacaatgtgccctgtttgactaagtcaaatgaaatagggtggtttttgtttctgttcctaattcctttaaaaaatagggggaatagtattttagaattttatgcagaatttaattctctttttacggttaagattttaagattttcttacttgcacataaaaataatttgggttcttaaacttaatttctggcctgtgactagaatgtttaaaaaaaaaaaagtcggactaaatgttaattactgaaacattaacttaatttctaaaaccatggtgctatcatttattaatctgtaatgtcttcatacaaaatgcagctcctgggctgggttttgggggaaaaaaaaaaaatgtgttctgtcctggtctggagtccgttgctgcagtctccttggttagttaagacaaagccctcattaacgtttgctgcaggacttaaaattttttacctcccaactaacaaacatagcctcacattaaatttaatgggtcagtaaagccccttttaaaggggctgctggaaaactcaatcaaactgatttgaggagcagtttaggtacatactgccttttgtttagctttttgttttccttactcagtctaactgaggctaattttgcaacttcaataacacttcggagtaaaagaaggaaaatatttaacatgtttttggtttttttcatttcttgcttaaaacaaaaaggaaggttgtatttggggggactggtttgatttgatggaatttctttccctttggttcttatttctgggttgaaaccaataagttttaaaactaaagaatgggttaataagcttcagacagataactgcaactgaaaactgcacattaagtaaaaaaaaaaaaaaagaaaaaaaaaagaaaaagaaaaagaaaaaaaatcctattttgtctttgttgccagaaatcagtgtggtgtcaaacactccaaatgactgtcaagtataaattcttcttccacttcatttttggcagctgtttgttaaggcatctaataacagatgtgagaactgtaatgtgtacaatgtgtatgtgtccttggctgtcagtcccattgcagtttcaatgtgtgtttctatatgcagtatatactaagctaatgtagttgttttgtcctttgtcttatctgtgctctatctctagtccggagtggtacagtcccattcctgcagtcctagtgaatcagtgattcttgggggttagtgggttttgtgtggtggccttcctctgtaatgtcaccctatgctgcttctactgtctgtgaatcttccgttttaccttttaaaattcctgctgttgctttgctggtgtatattctccctacctctcctctctttccctccctttcccatctccccctctccctcctcttcattccttccccatccccaaaatctctttcattctcagagataaaaagactcttaactagctcaaggttaatggagccatttttcccacaacggaattctgggtatgactctgtcttctggagtgcaacacaaagcactgaagaataatgctcagatatattaaataaattgatgccatatagcctcagttgttaacattcccagagtcccttgtgctctacctataagcagtgggtgcttttctttggtttcctttcaggttggctgatggagcaatatataaagcaattaccagtgagacagaaaattctttcaaaggtcaaccaacatttttaagaaacaaaatgggaggggataatggaatctagaattgtcatatatatttgtttacttgtgcaatgctaatatagtaactcggctgtcctttgaatatcactgtgttgagtagattcctctaggacctttgatttcatgagttgggcccaaaccgtggtggaataataacaaaaagaagttaaatgccacaaattttaatagtgagcttacttgaaggatttaagtaggtttaggaggtgaagaaggccgatggagaaatttacagattaattttggaagctctactctagctatcgaacaatcaaaggaatgcacctatcagctacaaagaacagctagacagctgttttttttcttttataaatgtttctgtgttgtgtcaaaatgatttctggtgatttaaactaacagataatcacagctgctgtctaaattcatagtgttgaaaattacaaaatgaaaaaaaaaaaaaaaacacttcattacctgtgaagactgtgtctgtgtttttaactatttcttgtacaaatatatgaaaacttttatgaggagactggtgccaagtagctgaataatggggaaagggatattctgttcgtaaaaatcttagcagtgttaccaactctacgatatatatataaaaaaataattaaaacgttacaaagcgacagctatggtacatttgttttgtgtgaagctaaccggacctaacttcctgagtgcctggcttattttgaaacattttttttcattgaccattgataatgctgcaaatcagaaatgtacatacttcatttacaacagggttctttttatacttttgtagattctcatacatgtcacatacatggttgtctttatgtaacttaattttttcatccgcaggtgccattttcataataaacttctcttggatttgttacta

SEQ ID NO: 20075 - DNA, 2802 bp, Homo sapiens
atggcgcccaccaagcccagctttcagcaggatccttccaggcgagaacgaataactgcccagcatcctctgcccaaccaatcagaatgtaggaaaatctacagatatgacggaatctactgtgaatctacctaccagaatttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 20076 - DNA, 2763 bp, Homo sapiens
atggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagggatacaaatgtggaaatctgaactctgcatgagaaagacaccatgtgaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactga

SEQ ID NO: 20077 - DNA, 2531 bp, Homo sapiens
gattttgtcacctgagactgctgttactctgaaaatgatagcattaacttgtctaattctgagaaagacatttgttagctaatgtagactattaatagagcaaacataaaactggttgggtattagcctagcaagtatctgaccagagcattatggcattacttagattacatagatattcagtaagatatttcaggtgtgatttctgcagtgaatacagtgtttacaccagaaaacaatgtcaggaatcctataatgtaatagggaatattattcaccatagtatattaaaagagaacggagccttgctgctgaaccaattttgatctcttcctttggtcttccttccttccttgtttctctctttcttattatttcataatgaaaaaaaagaatgctagactcaaatatttacagtgctttcagaattcaataaaatgcatacataaaaatgattttaatagtaccttgatactgaaaatattatctagctacttatcattgtggtctgatttttaaatttatttctcatcagacacaatacagagcaattcagagcaggtagaattctcctgtcagatgctcacacacaacttcagttgtgccagattctgccctcagcaatgtgagcaaacttcaaacagaaatgcacatgaatagttgaaggaaaatgctggatcccacctgttgcctcttctgggaagtaatatgtctataatgtttataaattttaataacccatacagcgctttatctttcaatattaaatttatattttcctaaagtttgacttctttgggcaatatattttattctctagtatcttagaaaatcaatctactaatgtatgtccattaataaataagtatgctcttatcaagcagttatcagcacatttataaaattacattgaaatcttcattttaaatatgatgttttcttcatctaactgaacgtgctgtgatctttattgagggctggaaacatatttgttgattctgacaaggtgaattgtattcgtgtttaccttctgctccccaagattataattgaaatgaatttttcaaaatagttccttttgatgaagatcccatactgatgaaagttaaatgaacagaagtattagtttgaaatagatacacgaatgtaagcccaacttataaattgattctagttgataatatcaagctacgcctgtaaaccttctgttaggtcttagaaacaataaatacacctcaatgcatggacaattgaaggaaaaaaaccttaacaagtaaaacacaatttttactcattggacttgagtttacaaaatgtaaggccagagttagagtttatggctttagtggacattttctggaactcattttactgtcactctctagttttgaaatagtttttggtagaattttggtgggaaaaaaggaaatacaaagaaagcagtatttgaatgatgacagagtcacatattctaaaccacacattctcactcctttgatttcagtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaaggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggtttgcttcccaccagcgagtgatcagtttcttctgtaggacccctgtcaggaagaacatgcctggatcctacttcagagagaactcagccagggcaaggggctcttgtggctttttgggtgggtgtgagttcatagaggggaaaatcaatactgtaccaggatttagacaatttagcaaaatgcatgaggcagtactttggatgatgaataactacagctgcatggctaacccattggttgtgtaaagtatgggttatcatgttttgtctaaattttcaggcaaaatctagcctgttttgtggcattaggatcatcattatagtagtatgatttttatgctattatacttacgctatgtcccgaatgtttttaaggccagcaaaatggaaacagtagagtacttgcctgaatgcaaataaacttcagtttcaactta

SEQ ID NO: 20078 - DNA, 2926 bp, Homo sapiens
ggggagagaggcaaaaagtaagagaggaaaaaaaatagcaggaagatggcgcccaccaagcccagctttcagcaggatccttccaggcgagaacgtttacaagcattgagaaaggagaaatcccgagatgctgctcgctcccgccggggaaaagaaaactttgagttctatgaattggccaagttgttgcctcttcctgcagccattaccagccagctcgacaaggcatccatcattcgacttacaattagctatctgaaaatgagggactttgctaaccagggggaccctccgtggaacttgcgaatggaaggccctccacctaacacatcagtaaaagttataggtgcacagcgaaggagaagccccagtgcactagccattgaagtatttgaagcacatttgggaagccacattttgcagtccctggatggctttgtatttgcactaaatcaggaaggaaaatttttgtacatttccgaaacagtctccatctacctaggcctctcacaagtggagctgacaggcagcagtgtctttgactatgtccaccccggagatcacgtggagatggctgagcagctgggcatgaagctcccccctgggcggggtctcctgtcacagggcactgctgaggacggagccagctcagcatcttcctcctctcagtcggagacccccgagccagtggagtcaaccagccccagtctgctaaccactgacaacactcttgagcgttcctttttcatccgaatgaaatctactctgaccaaacgcggtgtgcacatcaaatcatcaggatataaggtgattcacataacaggccggctacgcctgagagtgtcgctgtcccacgggaggaccgtccccagccaaatcatgggtctcgtggttgttgcgcatgccttgcctccccctacgatcaatgaagtcagaattgactgccatatgttcgtcactcgagtaaatatggacctcaatatcatttactgtgaaaataggattagtgattatatggatctgacccctgtagatatcgtagggaagagatgctaccacttcatccatgctgaagacgtggagggcatcaggcacagtcacttggacttgctgaataagggtcagtgtgtgacaaagtactatcgctggatgcagaagaacggaggatatatttggatacagtccagtgccaccatagctattaatgccaagaatgcaaatgaaaagaatatcatctgggtgaattaccttcttagcaatcctgagtacaaggacacacccatggacatcgcacagctcccccatctgccggagaaaacttccgaatcctcggagacatccgactctgagtcagactctaaagacacctcaggtattacagaggacaacgagaactccaagtccgacgagaaggggaaccagtccgagaacagcgaagacccggagcccgaccggaagaagtcgggcaacgcgtgtgacaacgacatgaactgcaacgacgacggccacagctccagtaacccggacagccgcgacagcgacgacagcttcgagcactcggactttgagaaccccaaggcgggcgaggacggcttcggtgctctgggcgcgatgcagatcaaggtggagcgctacgtggagagcgagtcggacctgcggctgcagaactgcgagtcactcacgtccgacagcgccaaggactcggacagcgcaggcgaggcgggcgcgcaggcctccagcaagcaccagaagcgcaagaaaaggcggaaacggcaaaagggcggcagcgccagccgccggcgcctgtccagcgcgtcgagcccaggcggcctggacgcgggcctggtggagcccccgcggctgctgtcctcccccaacagtgcctcggtgctcaagatcaagacggagatctcagaacccatcaatttcgacaatgacagcagcatctggaactacccgcccaaccgggagatctccaggaacgagtccccctacagcatgaccaagccccccagctctgagcacttcccgtccccgcagggcggcggcggtgggggtggcggtggcggggggctgcacgtggccattcccgactcggtcctcaccccgcccggcgccgacggcgcggccgcccgcaagactcagttcggcgcctcggccaccgcggccctggcccccgtcgcctccgacccgctgtcacccccgctctcggcgtccccgcgggacaagcaccccgggaacggcggcgggggcgggggcgggggcggcggcgcggggggcggcggccccagcgcgtccaactccttgctgtacactggggacctggaggcgctgcagaggttgcaggcgggcaacgtcgtgctcccgctggtgcacagggtgaccgggaccctggccgccaccagcacggccgcgcagagggtctacaccacgggcaccatccgctacgcgcccgccgaggtgaccctggccatgcagagcaacctgctgcccaacgcgcacgctgttaacttcgtggacgttaacagccccggctttggcctcgaccccaagacgcccatggagatgctctaccaccacgtgcaccggctcaacatgtcaggaccgttcggcggcgcagtgagcgcagctagcctgacgcagatgcccgccggcaacgtgttcaccacggccgagggactcttctccacgctgcccttccccgtctacagcaacggcatccacgcggcacagactctggagcgcaaggaggactgaggcgccgcccgtcctgggcccggccaggccccgcttggaggaggcatcgtcggcattttcgtttagacctttaattctagcactttgaattcgagcaggtcagcgtcttctctcgccacgacggtccccattccaccccctctttctttcacctgacttattctttcgt

SEQ ID NO: 20079 - DNA, 3303 bp, Homo sapiens
gctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtgtcctaatctacctgggctttgagcgcagtgaactgctttgtaaatcatggtatggactgctgcaccccgaggacctggcccacgcttctgctcaacactaccgcctgttggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccacccccccgggactgttggggggattctgagggccagagggggatatatatgattccccaggccctgcaggattttggggggggggaggtgggagggcaagggaggggagcttctttttaaaatcaagagacttcgagcgatcccagtttccatttcaatctgtattcactcgtagtgagtttccttgaatgggatttcaagcggagaatgggggagtctcacttccccgccgccttgccccattggcctgggccagttctccactcctaggggccaagccacccctagccttggtgggggaaaggcagggcccacccgggccagcccgtgccctgaggggctcttgacacccacgtagaattctctacacaccagtaacgggatttcaattccgatggactctgccgccctggcggcccttcctgtgacttttgcgccccgcgcctggggtggggggtgcgaagagacgctacgttcctttccgatggaggaaggcagacctgccgtcacacgtgtgcttgcacgagtgcgtgtacctggtgcgggactcacccggccgccagactgcctgggcctgcccagatggccacctcgtggtgctgcggtgactttgtagccaactttataataaagtccagtttgcctttttggta

SEQ ID NO: 20080 - DNA, 2454 bp, Homo sapiens
ggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggcactcctctggcgggccccacggggcttctctcagctcaagagcttgaggacatcgtagcggcactacccggctttctgcttgtgttcacagccgaggggaaattgctctacctgtctgagagtgtgagcgagcatctgggccactccatggtggacctggttgcccagggtgacagcatctacgacatcattgacccagctgaccacctcactgtgcgccagcaactcaccctgccctctgccctggacactgatcgcctcttccgctgccgcttcaacacctccaagtccctcaggcgccagagtgcaggcaacaaactcgtgcttattcgaggccgattccatgctcacccacctggagcctactgggcaggaaatcccgtgttcacagctttctgtgcccctctggagccgagaccccgcccaggtcctggccctggccctggccctgcctcgctcttcctggccatgttccagagccgccatgctaaagacctggctctactggacatctccgagagtggctgagagtggagatattcaggcagagatggtggtgaggctacaggccaagactggaggctgggcatggatttactgcctgttatactcagaaggtccagagggacccattactgccaataactacccaatcagtgacatggaagcctggagcctccgccagcagttgaactctgaagacacccaggcagcttatgtcctgggcactccgaccatgctgccctcattccctgaaaacattctttcccaggaagagtgctccagcactaacccactcttcaccgcagcactgggggctcccagaagcaccagcttccccagtgctcctgaactgagtgttgtctctgcatcagaagagcttccccgaccctccaaagaactggacttcagttacctgacattcccttctgggcctgagccttctctccaagcagaactaagcaaggatcttgtgtgcactccaccttacacgccccatcagccaggaggctgtgccttcctcttcagcctccatgagcccttccagacccatttgcccaccccatccagcactcttcaagaacagctgactccaagcactgcgaccttctctgatcagttgacgcccagcagtgcaaccttcccagatccactaactagcccactgcaaggccagttgactgaaacctcggtcagaagctatgaagaccagttgactccctgcacctccaccttcccagaccagctgcttcccagcacagccaccttcccagagcctctgggcagccctgcccatgaacagctgactcctcccagcacagcattccaagcacacctggacagccccagccaaaccttcccagagcaactgagccccaaccctaccaagacttactttgcccaggagggatgcagttttctctatgagaagttgcccccaagtcctagcagccctggtaatggggactgcacgctcttggccctagcccagctccggggccccctctctgtggatgtccccctggtgcccgaaggcctgctcacacctgaggcctctccagtcaagcagagtttcttccactactctgaaaaggagcagaatgagatagaccgtctcatccagcagattagccaattggctcagggcatggacagacccttctcagctgaggctggcactggcggactagagccacttggaggactggagcccctggactccaacctgtccctgtcaggggcaggcccccctgtgctcagcctggacctgaaaccctggaaatgccaggagctggacttcctggctgaccctgataacatgttcctggaagagacgcccgtggaagacatcttcatggatctctctaccccagatcccagtgaggaatggggctcaggggatcctgaggcagagggcccaggaggggccccatcgccttgcaacaacctgtccccagaagaccacagcttcctggaggacctggccacatatgaaaccgcctttgagacaggtgtctcagcattcccctatgatgggtttactgatgagttgcatcaactccagagccaagttcaagacagcttccatgaagatggaagtggaggggaaccaacgttttgaataagtctgtgacttaacgtcgtcaagtatggcatattgtcatcaagacgtggagccgctctccac

SEQ ID NO: 20081 - DNA, 5437 bp, Homo sapiens
agtgggggcctgatagcgcggcggtgtggaccgcgcggccgaagagcgcggcgcccagagcgcgggccgctcgcggagccacagcccgagccgggtcccagccggagccgagccccagccgagccgagccgggcccggagcgcccggtgcccgcagccatgccggccggccgcgccgcgcgcacctgtgcgctgctcgccctctgcctcctgggcgccggggcccaggatttcgggccgacgcgcttcatctgcacctcggtgcccgtggacgccgacatgtgcgccgcgtccgtggccgccggcggcgccgaggagctccggagcagcgtgctgcagctccgcgagacggtgctgcagcagaaggagaccatcctgagccagaaggagaccatccgcgagctgaccgccaagctgggccgctgcgagagccagagcacgctggaccccggagccggcgaggcccgggcgggcggcggccgcaagcagcccggctcgggcaagaacaccatgggcgacctgtcccggacaccggccgccgagacgctcagccaactcgggcaaactttgcaatcgctcaaaacccgcctggagaacctcgagcagtacagccgcctcaattcctccagccagaccaacagcctcaaggatctgctgcagagcaagatcgatgagctggagaggcaggtgctgtcccgggtgaacaccctggaggagggcaaggggggccccaggaacgacaccgaggagagggtcaagatcgagaccgccctgacctccctgcaccagcggatcagcgagctcgagaaaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagttgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggaggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttggtgagaggatctgtgtgtgcgtgtctacatgtgtgtgtctacgtgtgtgcgtgcgtggctgggggaggccttttctttgaggacgtacctcatttccttctttcttctggctttggaaaaatctcatgatgaaaattcatatttgccaactttgttagctgcgtgcgtgctttggggttggtgcaacctcagtacacgcatttgtctttgtttgcaaacctttctcagagcgacatatctttatattgatgtaataaatgtcttttagtggtttgtcaaaggccgggggcgggggctctctacagagaatttttattttgtaatagaagtgaactgtctctgaagggtgaaggcaggccgtcctgggatggtaccctgtgctctcccgtggaggagaggggatggctgaggacactggcccttaccccagggccagacagcatccatccctgctgtttgcatctgagagcagcatggggcctgggaggtcggcctgtgtgcccagctcagctagctctgccccaggacggccctgccctcgaccttcccacctcctcagatcctgcaaggctggggtctgcccctcccttctcacctctggagctgtgctgcactgcttcagcccagagggccctgagagaggagcgtgccacccacagcccgggaagccgggccccagcacccctctcctttggcctccggcagtgcagaccagaggggaccttttaaggaaagaagccgtgtttcgatgaagacctggccacatggggccactgggacttcaacccagcccatcggtgggaaggtcctttttgggggactttgacagccatatccctcccagcacaccaggcgccaggtgagctggttcagacccctccaggggtactccagagacctcacgtgtggagccaggcctggccagggcaggggcctgaaacccactcctccatctcatggggctcacggcctacagcagcccacaagctgccactggccggcgacactgacacctgagcagtgtccagaacctttttgcctttttttgttccccgtgaaaagcaacatggacatttccttctagtccttccaaggaggggagagaagtgtatgtgcatttgtgtgtgtgtgtgtgtgttgtgtgtgtgtgtgcgctaagtgagaaagagagcaggctcgggaggccctgcccagggtaggaggagcttcctgctttgcaccatctggtggtcgcacgccctgagggcaccccgactctgtctccaggagtctcatcagcaaaccgctgacaagtctttctagaaattctactgcactgcctggctcagctgcagctgcagacatttctgcaggaggagcaggtgtttctgtcttctgttccttctagggccacctgtccccttaaacacaggtccacgttgtgtcaagaacctagtgcatctgtgtgtgtctgtcagtgtctctgtgtcagtgttctcgtgggtgtctgcacggtacccggccgccgttctgcaatgcatcactcccgcagaggggggtgcagatcaggcgccgtgctgcgcgttgttgttcaacagtggctttttcttagataatcgtgcttcctcagcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaagcccaatacttagagtcccaattttgtctcatttgccaaaaaaaaaaaaaaaaaaaaagcaaaccccctatggttgatattgttataatgtatatactgtataatatgaaagagaatcgatgtatctcactttttcattatttgctaaccaaagctgtacatttttcatatgatctgcagccttttgggtatcaaatgggtcaaaaccatgggacctgccacctcccatcagcaattctggaaatgcactatttctactggtattcttgctttttttttttttttcattttcttgctgaaatgacatgaattgttgagtttatttttacacagtaaagagtggagaaagact

SEQ ID NO: 20082 - DNA, 3957 bp, Homo sapiens
agatcagaaggaaggacctcaggagggagggagagggaaggagcggagattggggaatgaaaaacacccggagaaaggccaggggctgggcccctccctatcccccactgcaggcctcaatgggttggggtagccgctggggtgctgcactgagggggcctgccctgctctgctccctgccagttggtttagaggagggggtggttgctgaccgggcaggatgtcttctagaaataatttttggcctggggaactggtttctttctgggcttcctggcaggaccacggctgctcacccagggattgaccaaggggtgtgtgttcctgggctctgggcctgctactgtgcccattgctggccaggaatgttttgcctggagtcagtcacaccatacccagggtgccacagtatatagatgggctatgggggttggcgcttacgggagaagtggccggtggggagggagaaggtgggccttgtggaaagggaggccaccaggcctggaacctgagctgtgaggacacttactcacctgagagtgtggcggcatcctagagcagtcaccttggggagccctggcgcccagagtactcccagctccttgctgccctgccctctcagcagagctccaggcagagtccctgctccaaggaagggccttggaggtggggagctgcccagcctcacacccaagaggcattggtgggtcagaggcacatctggcctggagggaagtgtgtgggcaccagggcctggctgtcgggtggggagaggcaggagcagagcctgggattgagcgaggagaggctctgagccccgccccatcctggaatcaggtcggttactctcagggtagctagcctcgttcctcctctgcagccacccctgctccttgggttgacttggcttggcggctgtccccattcccttctcatgcccaccacgcagcccagtgttgatgcagcagcccaccaggcactgccccccacccccatctccccaaggatgccagcacatgggcgtgacagcaggccagacctggagcatgaagagcttgggtcagctctttacagactggccctgtgccttggggcaaagtacttgacctgggaagctacccgctctgcgtctccagaatggagaccggagcctgccctggccacgcatcacagagcttggtggggaccgaactcaactcagacaccgataagcacttcacgcaggtgcagatgtcaggactgtgtcttccgcaggtcagaaagacaaccgccctggagacaagttccagctcacattcccactgcggaccaactatatgtatgccaaggtgaagaagagcctgccagagatgtacgccttcactgtctgcatgtggctcaagtccagcgccacgccaggtgtgggcacgcccttctcctacgctgtgcccggccaggccaacgagctggtcctcattgagtggggcaacaaccccatggagatcctcatcaatgacaaggtggccaagttgccttttgtcatcaatgatggcaagtggcaccacatctgtgtcacctggaccacccgggacggggtctgggaggcctaccaggatggcacgcagggtggcagtggcgagaacttggcgccctatcaccccatcaagccccagggcgtgctggtgctgggccaggagcaggacactctgggtggtgggtttgatgccacccaggcatttgtgggtgagctggcccacttcaacatctgggaccgcaagctgacccccggggaggtgtacaacctggccacctgcagcaccaaggctctgtccggcaatgtcatcgcctgggctgaatcccacatcgagatctacggaggggccaccaagtggaccttcgaggcctgtcgccagatcaactgagcacggcaggccaggctgagcccgcccgccctcgccccctgcttgtgcggcgatgatctgttttgtgcgtctcttctctcccttttccccaggaatgaaccgaggccgtcgcccctgcacacgcacacgcacacagcctggttttgtcctcatgcacacgaagcagcccctgctcccatctgtccctgaggaagccccacttctctgtaggagcccggactctctcaggcatgccccattcacagctgaagtgggtgctgcaacgtcttgaacaaggcagaagttgcgcccgtcgggttgtggcatccttggatctgcagggatcttctccgtttgcatgttcctcggggtggcgtgttccttgctccctgggtccgacatgtgttcccgcacctgcatggactgccccggttctgtgttgtgtgccgagtgccgcccagtgttctgtgaccacccgtgtagctactgaaaatggctgggtaagcaagtcaagggtgttggaggaggtcaagagagagctcagtttccctctccccctccccaaacacaccaagaagcatttttaacgtgtaggttgagaacaagcctaaaggattcccacagctgggagccagcaagagagcttggagtcgcctctctagaccagatctagccccaccctcactccagccatctcggagcccttgtgtaggcaacgcccggtgcgggctgtgtggggtgctcccctgccagcacctccggccagccccgcccctgccgatctactggaccgcagaccaccttctgcccccgtgggccaggtgggagctgtccgttcaggaccatgagccatcctctgccctgactagcgaggggcagagcacaccccagtgcttacgcctccacccctgcagcctcctggcccgctcaccttcctcacccctcctctgacccacccatggtgccagggccgaagctgacctttagctccctcctgccccttgctagggtctgagccaagcccctcgactccctcactgtgttgacacttggcactttgctggccccgagaaaggtcgatgacacagccgcaaatctaatccacgtagttcccatttactccttaatctgattgatgttccctcttgcactgaataatacatgcctctctcaggtaagccattttataaaacaagaagataaaaagcactgttgaggcagtgtttgcttttgccgagctggtgtccgacagctccctgggtgtccggggtgggagagctgttgacagaagctctccgggccctcaggggcttagatcccacttgagtcgtaagccttcttgcttttgataacacagtattatttctcttactgtagaagaaaaagtttattaccaaacaagagtatttttatgaaagaaaaggacaaacctataaattaactcaacctatatctcccttgaaaatactttcaggctccaccaaaacgtagaactgaaagcatgtattttggaagaaagagatacattttgtatgctttcttttccttttgtagattcccagtttattttctaagactgcaaagatcactttgtcaccagccctgggacctgagaccaagggggtgtcttgtgggcagtgagggggtgaggagaggctggcatgaggttcagtcattccagtgagctccaaagaggggccacctgttctcaaaagcatgttggggaccaggaggtaaaactggccatttatggtgaacctgtgtcttggagctgacttactaagtggaatgagccgaggatttgaatatcagttctaaccttgatagaagaaccttgggttacatgtggttcacattaagaggatagaatcctttggaatcttatggcaaccaaatgtggcttgacgaagtcgtggtttcatctcttaaacacagtgtgtaaatttattcaactaacgatgggaaatgtattacttctgtacacagtggactgaagtgcaatttgttgaaagggaacaagtcattgaagagaaaaaaaaagcccaatacttagagtcccaattttgtctcatttgcc

SEQ ID NO: 20083 - DNA, 2700 bp, Homo sapiens
agcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcgtgctgatcgagtggggcaacaaccccatcgagctgctcatcaacgacaaggttgcgcagctgcccctgtttgtcagtgacggcaagtggcaccacatctgtgtcacctggacgacacgggatggcatgtgggaggcattccaggacggagagaagctgggcactggggagaacctggccccctggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagat

SEQ ID NO: 20084 - DNA, 1294 bp, Homo sapiens
gcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaa

SEQ ID NO: 20085 - DNA, 1209 bp, Homo sapiens
gtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaa

SEQ ID NO: 20086 - DNA, 322 bp, Homo sapiens
cagattttgggaagtccaaaatgattagctcagtaaaactcaatctcatcctagttctgtcgctgtccacaatgcatgtgttttggtgttatccagttccatcttctaaggtgtctggaaaatctgattactttctcattctgctgaacagctgcccaaccagattggacaggagcaaagaactagcttttctaaagccaattttggagaagatgtttgtgaaaaggtcctttcgcaatggagttggcacagggatgaaaaaaacttcctttcaaagagcaaaatcatgactaagtgtgcaaaggactcggggaattaatct

SEQ ID NO: 20087 - DNA, 848 bp, Homo sapiens
gttgtgctgctctacgcctctacctacgtcctggtgtccctcagcatagacagataccatgccatcgtctaccccatgaaggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctgggctccttgataaccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 20088 - DNA, 1410 bp, Homo sapiens
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggtcatccgtctccgtcagctccaggaggctgcgctaatgctctgccctcaacgagagaactggaagggtacttggccaggtgtaccttcctgggctcttccaaggtgacagctctcaccctgtgctgcaggtggccctgtgcctggtgccacttctcactgcttaccagggcacaaggacaccagtggttcccaaaatgggtcacagcaggatggcctgcatcagattcaccagggagggctataagaaggcagac

SEQ ID NO: 20089 - DNA, 1567 bp, Homo sapiens
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 20090 - DNA, 1233 bp, Homo sapiens
agccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggctaatagcagtgtctacctgttggcctgtgatgtctctgtcctctgggctctggtgctgaccagtgagaaggagagctgtgagtcatggagaaggaagggagcaaagatcacaggattccagaatgacgttccgggagagaactgagaggcatgagatgcagattctgtccaagccagaattcatctagaccctagggcagt

SEQ ID NO: 20091 - DNA, 1369 bp, Homo sapiens
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcattagtggtccagggtcctggcttggagccagtgagtagac

SEQ ID NO: 20092 - DNA, 856 bp, Homo sapiens
agcacgtagatcctccctgtcatcaggcagagctcttcagtgaggtgggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggtcatggtaatgaagttattccatattcagaaaatgaatatggaatagttacaatcttcttttgtgctctgaatataaccttgaaagtttggtatgtctgaaagagccttttctattatgtacggctagtattttctcaggggaaatttttaaaaacatatttcaatttctttctgaggatatttgcttccttgtaaataaatgctttcaattgcttattatattagcaatcaattgctgatacacaaattatgacaaaacatggtggcttaaaacaataaacatttattatctcaca

SEQ ID NO: 20093 - DNA, 814 bp, Homo sapiens
gggctcagggagggctctgtgcctccgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagtataacaagcccacctgcttgagctgggctgcagtggccagggtaaacatccaaggcaccagtgaaaaatacagagaaggtaaaaggagcaagagttctgaagatggaacctgggatgggggaaagtttcttcaatctttcctaccaacaagaactccaatttttcactcctataaccgtagaagtagaggtaattaggatcatccagcaaatgcttagaggcaaatatccctggatgaggatgccacagcttattttcattatatttcttcgattacagtgtggtaatgcatgttgtatggaactacatattctttcagaatgaaaggatttagaggtggcaagaatatcagcttgaaatttaaagttttttcataaacaataaacaaatgataattgaaaattc

SEQ ID NO: 20094 - DNA, 585 bp, Homo sapiens
aaagccctgtcgcgacccgctctctgcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattcaaaagtg

SEQ ID NO: 20095 - DNA, 565 bp, Homo sapiens
cgggactgggacgagagcggattgggggtcgcgtgtggtagcaggaggaggagcgcggggggcagaggagggaggtgctgcgcgtgggtgctctgaatccccaagcccgtccgttgagccttctgtgcctgcagatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgt

SEQ ID NO: 20096 - DNA, 705 bp, Homo sapiens
gcaccccatccgctggctctcacccctcggagacgctcgcccgacagcatagtacttgccgcccagccacgcccgcgcgccagccaccacaagagtttgggcaagaagggagaaaagtgacccagcaggaagaacttccaattcggttttgaatgctaaactggcggggcccccaccttgcactctcgccgcgcgcttcttggtccctgagacttcgaacgaagttgcgcgaagttttcaggtggagcagaggggcaggtcccgaccggacggcgcccggagcccgcaagatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgtttt

SEQ ID NO: 20097 - DNA, 3029 bp, Homo sapiens
aaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgccgtcacgtgatccgggatgaggtggagttcggctttaaggaggcgtctcttcctagcttcatcaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtctgaagtcattcagaagtggtttgaggtttctgttttttggtggtttttgtttgttttttttttttttcaccttaagggaggatttaatttgctcccaactgattgtcacttaaatgaaaatttaaaaatgaataaaaagacatacttctcagctgcaaatattatggagaattggggcacccacaggaatgaagagagaaagcagctccctaacttcaaaaccattttggtacctgacaacaagagcattttagagtaattaatttaataaagtaaattagtattgctgcaaatagttaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgag

SEQ ID NO: 20098 - DNA, 559 bp, Homo sapiens
attattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggagattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgat

SEQ ID NO: 20099 - DNA, 1017 bp, Homo sapiens
aatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcaga

SEQ ID NO: 20100 - DNA, 753 bp, Homo sapiens
ttgcattcggactgcaaaattctgctgaaagagccttaggctattttccatggtctaaggtaaaatcgttttggctttggtccaacacaacgcctcagttcctttaaaagattaactaaaggtctgtgaacttggaaaaaagaattcccgtttctggaattcgagttctatggatgtttgttattgctcgcatttgttatatgaagacacctcgcaaacaggagcgcaaaccttagagcgcagctgcctcccgggctcgggtcagcgctggaccgcgcggcagctggacggcctgagtggcgccccgcgggctgcgcccccggcctcgccagagacccgctagggttgagccctgacccgggcaccccgcgggctgctgttcccagctccggatgccagccgggctgcagccagagcgcgtccagccgggggcagcgctttgtccatcccccgccccatccccaggaggctccttcgcggatccccgacactctcctcccgggttcggcccgcgcctgctccacccggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagct

SEQ ID NO: 20101 - DNA, 799 bp, Homo sapiens
gaaaagcagtagctgtttgttctcgaccctgggccggctctctggcgaagcaagcgagggagcagaaagctaacccgaccaggttccccacccaggactagaccgagtgctcttccgtgactactactttattagtctttattgtcttaaggcagcagtctgttgaacaagccctccccagcaaggaaggagcagagaattatgtaattcatttagataagctagcagtaactttgggaggctgtatgtaacaaggctgacatttcttttccaacacaagtgaggtgaacagccagccaatcctgagtatttgaaaaaatgtatctgcagcaggttatgatcagggagctgtattttcaagtagtaacagcactgcgaagagcaagcaatgaaaggccagcattctaattggaaagaaagaagaggaaatttccctctgcaagggggctaatttgccaactggtgatattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggcct

SEQ ID NO: 20102 - DNA, 3626 bp, Homo sapiens
ggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatga

SEQ ID NO: 20103 - DNA, 3518 bp, Homo sapiens
cttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaga

SEQ ID NO: 20104 - DNA, 1843 bp, Homo sapiens
agcgatcgcgctgggccgcgctcccgggagcccagggcctgcagcggccggggcgccccgaggtctgctcattgtgtttttcaggaaaaaggaagggaaagggtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaattttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggttgtattaccttccacttccatgttgtcttataaacaaatgaattgtattttttgttgaaagtaaaagttatatctaaccaa

SEQ ID NO: 20105 - DNA, 1418 bp, Homo sapiens
gtaatgtttttttggttgctgacaaatgtctttttattccaagcaggactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaa

SEQ ID NO: 20106 - DNA, 3183 bp, Homo sapiens
ccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctccggttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaactcgaattccagaaacgggaattcttttttccaagttcacagacctttagttaatcttttaaaggaactgaggcgttgtgttggaccaaagccaaaacgattttaccttagaccatggaaaatagcctaaggctctttcagcagaattttgcagtccgaatgcaattttagatttcagatttctcaagggaagagaaactctgctgttagaatttggaagggagggtggtgcatgcctgtgtgtttgtcagctgagcagagctgtatttatctttccaattcaaattgtgccagattctggctttaagaacaaaccatgggaatatttgagaacatggaatcatgctgctgttccacgatcacagcaaaacagacaatagttgatattgtatcattgcaggaggaaaaagaattacatatattttattcttttgtgtgattgtcatcctttgtgaaaagaatgatgtgtattttcataaagcaaaaaattattcaaacaaagaaaccttatttaaatgtacaagtcagacttttaatatcctttgaattccctgcagttcctcctattattcttgagaactatctactttcttaaaatacttaaaatctattcagaaggtttcatttgtctaggtgtcagatatagaagagtttataagaaaattccagtaaacctttaaaaagatattattttttataagttgccatagtttaataaagaacttttatttttcacactttttactcagagattaaagttctgtgtttcagcctggaaattctgatggtgggagatacaactaatacaaaagagaatgagtaaatatagtaattaggtctgctcattgtgtttttcaggaaaaaggaagggaaagggtgttacaaggaaaggctatcggtaacaactgacctgccacaaagttagaagaaaggattgattcaagaaagactataatatggatttagagctcgacgagtattataacaagacacttgccacagagaataatactgctgccactcggaattctgatttcccagtctgggatgactataaaagcagtgtagatgacttacagtattttctgattgggctctatacatttgtaagtcttcttggctttatggggaatctacttattttaatggctctcatgaaaaagcgtaatcagaagactacggtaaacttcctcataggcaatctggccttttctgatatcttggttgtgctgttttgctcacctttcacactgacgtctgtcttgctggatcagtggatgtttggcaaagtcatgtgccatattatgccttttcttcaatgtgtgtcagttttggtttcaactttaattttaatatcaattgccattgtcaggtatcatatgataaaacatcccatatctaataatttaacagcaaaccatggctactttctgatagctactgtctggacactaggttttgccatctgttctccccttccagtgtttcacagtcttgtggaacttcaagaaacatttggttcagcattgctgagcagcaggtatttatgtgttgagtcatggccatctgattcatacagaattgcctttactatctctttattgctagttcagtatattctgcccttagtttgtcttactgtaagtcatacaagtgtctgcagaagtataagctgtggattgtccaacaaagaaaacagacttgaagaaaatgagatgatcaacttaactcttcatccatccaaaaagagtgggcctcaggtgaaactctctggcagccataaatggagttattcattcatcaaaaaacacagaagaagatatagcaagaagacagcatgtgtgttacctgctccagaaagaccttctcaagagaaccactccagaatacttccagaaaactttggctctgtaagaagtcagctctcttcatccagtaagttcataccaggggtccccacttgctttgagataaaacctgaagaaaattcagatgttcatgaattgagagtaaaacgttctgttacaagaataaaaaagagatctcgaagtgttttctacagactgaccatactgatattagtatttgctgttagttggatgccactacaccttttccatgtggtaactgattttaatgacaatcttatttcaaataggcatttcaagttggtgtattgcatttgtcatttgttgggcatgatgtcctgttgtcttaatccaattctatatgggtttcttaataatgggattaaagctgatttagtgtcccttatacactgtcttcatatgtaataattctcactgtttaccaaggaaagaacaaatgctggggtcatataaaatatatttatgataactatttacatataataaatagaaattttgttaacatggaatttaatttatgtgaaagagttctggattcaaatgtcagttcataatatatggaagataattttatgtgttatagtaggattaatttatttagttgtgcagtcagtgtcaatccaatctgtaatttcactttagaaggttgtattaccttccacttccatgttgtcttataaacaaatgaattgtattttttgttgaaagtaaaagttatatctaaccaa

SEQ ID NO: 20107 - DNA, 2687 bp, Homo sapiens
ttggaaataaccaatatttagtttatttcattcgattcttaggggaactggtgaggagcctaagatgattttcccttcctagagaaagaatccaaagtccagggaaatagcgacaggggagttcaagactgcccctgctagtccttccttggctactctccgctgcgatcgcaggatagctctcattagcaggagaatcgggcaagtgtgtggataagtagagagtgtgttgaacaacttgtaacgttttatgaaatacgcattgtcatggttccctaaaaggctttgcggaagccgtttgtctttactaatcaagtctttacttacacaaaagtagaagtagaagtagttttagaaaacatactaacaatcttctatccccttgaagaccagagtagcagaaaacaggtgatttgcattataaaattgcactcactttttcctcctttcagatttcacattacattagcctatttgtgttacggtgtataaaaaatggaacaggcgcctccactacattgttctcctttaaaaatagatcacttacaccctaactttgttttccttaaattcgattcttaacaggagagctttctattatttcagatggagtgaggttgcacgactgggatggaagaaaggaatcccttaaatttgggggaatttctgttctctgttctaagaccattttacttggggtgtgggggtgggcgcggcggtcagggcagtggaacgcagtcgcggctgcgccatccctgcacttccaggcgcgcgggagggaccggcggggacgcgagctgcggactctggcgaactcgggggaggcagacagggggaggcggacacccagccggcaggcgtctcagcctccccgcagccggcgggcttttctcctgacagctccaggaaaggcagaccccttccccagccagccaggtaaggtaaagactgctgttgagcttgctgttactgagggcgcacagaccctggggagaccgaagcttgccactgcgggattctgtggggtaacctgggtctacggaagtttcctgaaagaggggagaagggtttgcatttttcctatggaggattcttctctctctagcatttcgtttgatgtattcaactggtagaagtgagatttcaacaggtagcagagagcgctcacgtggaggaggtttggggcgccgcggcgccacccccacccctcctcgggaccgcgcctatttctaaagttacacgtcgacgaactaacctatgctttaaattcctctttccagccccgtgagtccgcggcgacattgggccgtggggtggctgggaacggtcccctcctccggaaaaaccagagaacggcttggagagctgaaacgagcgtccgcgagcaggtccgtgcagaaccgggcttcaggaccgctgagctccgtagggcgtccttgggggacgccaggtcgccggctcctctgccctcgttgagatggacaacgcctcgttctcggagccctggcccgccaacgcatcgggcccggacccggcgctgagctgctccaacgcgtcgactctggcgccgctgccggcgccgctggcggtggctgtaccagttgtctacgcggtgatctgcgccgtgggtctggcgggcaactccgccgtgctgtacgtgttgctgcgggcgccccgcatgaagaccgtcaccaacctgttcatcctcaacctggccatcgccgacgagctcttcacgctggtgctgcccatcaacatcgccgacttcctgctgcggcagtggcccttcggggagctcatgtgcaagctcatcgtggctatcgaccagtacaacaccttctccagcctctacttcctcaccgtcatgagcgccgaccgctacctggtggtgttggccactgcggagtcgcgccgggtggccggccgcacctacagcgccgcgcgcgcggtgagcctggccgtgtgggggatcgtcacactcgtcgtgctgcccttcgcagtcttcgcccggctagacgacgagcagggccggcgccagtgcgtgctagtctttccgcagcccgaggccttctggtggcgcgcgagccgcctctacacgctcgtgctgggcttcgccatccccgtgtccaccatctgtgtcctctataccaccctgctgtgccggctgcatgccatgcggctggacagccacgccaaggccctggagcgcgccaagaagcgggtgaccttcctggtggtggcaatcctggcggtgtgcctcctctgctggacgccctaccacctgagcaccgtggtggcgctcaccaccgacctcccgcagacgccgctggtcatcgctatctcctacttcatcaccagcctgagctacgccaacagctgcctcaaccccttcctctacgccttcctggacgccagcttccgcaggaacctccgccagctgataacttgccgcgcggcagcctgactcccccagcgtccggctccgcaactgcccgccactcctggccagcgagggaggagccggcgccagagtgcgggaccagacaggccgcctaggcctcctggggaaaccgactcgcgccccatacccgacctagcagatcggaagcgctgcgactgtgcccgcaggttgaccttgccaagccctccaggtgatgcgcggccatgccgggtgaggagaactgagg

SEQ ID NO: 20108 - DNA, 2328 bp, Homo sapiens
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctg

SEQ ID NO: 20109 - DNA, 8003 bp, Homo sapiens
atgacggaccccttcttcctgccttcaatgcctcagcggaagatccccaagggctggagcgaggagcgctgccgctggacatcctcccggggaggctgctccgacctgctgcgcggcgcgtctgagactggggactgagccaccccgccgccgccggcgccgccgccgccgcccgctccgtcgctgccgtcggtctggactggcccccacctcgctgcgccctctccccggccccggccccggctcggggcgtcccggggctcgccctgcgaccgccgcctcccgcgcgccgcgtcctcccgaccccgcggcggcgacgatgcccgggaggagggtcctgacggcggcggcgcggatggtggcggccggcgcccgggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtactggatatttgagttgggaaaatatcctttttgttagacacattgtgaaaagcatgcattgtcaaatactgttgttactcttccatttctttatgtcatatgcttgctacttacgactttttatataaatatatataaaatgtataataatttcctaatttgagttaagagaaatgttttcttccattagagtgattaaaaaactgactcacataaatacacattttatgtcaactctttccaccttttagggtacaggatgtccttcagtattgaggtttacttcccaaaatatttggcttctaaaagtttaggggaatattttcttcttttagaatagggaactctttttaaaactgctttaaaatcacaagcccttttatgaattaaaccaccattatgaattattcttattctcaggtacacataatacacctgaaagcttagtgattatgatgtgtttaacataaagtaaaatcctaaaatatattttactgctattaaattatatacacactctgtaaagtttgatttggtgagtggttattttttaaaatattcaatgtgtaatcttacaaaataaatttttaaaataagaattactatcagtatatatgcttcccaacattttcaaaactactgaattctccaggtttaaagaactctgtccttccactaacagagcagtctggtctactaaaatttggactttgcaattcaagcaggctttgcaaactagatgaattactgttatacttccctactaggaatacaatgtcatatatgttaaaaaataagcaaatagaaaataaatttttataatagaaaagtcaaagagttatcatagccattataaacactctatcttgaaaaaatgtcaagctacagaatcacttcaatgaatttgataaactagggaatcagaaaaggttttgaacatgacaaagattatttttcattgttatgctacatagttttatacacattgcttatgataaaatgtacccttttttatttggcttgactggtttatttattaccatggttccttttttgccctttaatttaaaattaatacaccaaagatttttttaaaggattaatcatatcttatattgctttctccatttagaaatcttcagaggactcctttccctttgaatgataatctcaaaagtatgatataactgtcaagattttttatttgtaacagcaataaaaatagtgaaataagttaggtgaacattttactattaatttgttctataactgtccggcatgtccgtcccctccagtttctcctgaatatacagaatgctgattccctgcttaaaaggtattttcaccagaaatctaccaatgggactttaaaaaaaaacactaaatgaagtataataataagaatgaatagctcacatatatttaacacacagcagcttcatgggaaaacaactgtattttaaatgaagaacaggcctcctcagtgataactctaaaatttctcaacaatgtacagacacagactaatcatgaaagaagataatgacgatgctgggcagtgtctggaggtagccttttctcctggcattcactctagatgctcaaacttgggagtgcagcgctctggcagagttgggagatgttctctggagggctctggcggtgcttatttatcagccagtattgaaatttgtcaatatatcaaaaacgatttagtagctatatcagaccttatcacctgaatgcagcctttggcccacattctaaaggtggtgacacacatagataaggaatgagatgtctcaagacttataagacatgttattttaataaatgattatattttttgataaagtgaattcaaatattaccaacccaagtgctttattgatttaacaagatgatttcaaataatgcattaagttagcctgctgtgttaatttcataaagctattctttttcattttattttttcaagttttcattcacttttcaaaataatggtagcatataatcacatgcaatgccaatgaatccccatattaagcttcgtacttctgtccaaatgtattgtagttgcctaatttcaaggttctaatttggaaatctgatttattttgtatgtttttatatacataccaattttaagcattatcttgcaaagtagacataggtggtgtttgatttgccataattaacttgaatttgattttgtaaccaaaatgtggctgtccacataattggagatcagtgtctttgggcttttaatggagaacaaatcacattgtggtgttgctggtttttctgtttcacatttacttttgctctagaagtatttccgtgagtctgatgactccataagttatgatcctcagtgttaagtaacttagacggttggcattactttaatattcacttaagcttctgtatcatttttttctgtatttttcccttaggaatttaattcgggtcttcctcaaattttacagctttaaaaaaattccatgaatgggttttcctcaacctcagaatatcataataaattacaagatatgaccccctggttcctattaccttgattaaagtggcggcaattaatttactgatgttttgtcagtgaaataaataatagcatcttatgaagtttgtgtatctctgatgaaaatgagtcatgtcagattccctctctgaagggaagttaaataaacaacatttttaaaattctttgaattctaaataaatatgctttgaaaagtgagttagggttttgtctaattgcactgaggcgagctagcttcggtgccatttttctctgtgcccttttccctccatggattcatttctatctattgcactctagcgtaaaggacccagccaagaaattgtaaaatagattcaacaacaaaataaacaggtcttgagttaattatcaatctctatgcacttaattaatatttcccaagcccatcttaaaggtgtaataaggtagaaaaataaaagtacactgttaaaatagccagaaatgtttttataaataatcctgctaaataaatctgaggccctttgttaatttacaattatgattcattttattaataaacttgtttgaattgtaccacaaatttaactgaattgtatcatcaaaataaataaaacagggtaataaaaataacaattagggtgactgatgtcagacactcatatcaactcatcattttcttgtagcctctgattctgtactttcttgtgtattattaaagaggtaaatgctctcttaaaatgcctctagttcctcagaggtaggaaaaataaactcaacctgctttggacttgtgtatttacttgggttggtttccagaatctccttattcctgaaacagtatgatcatgtagttaaactactcctttatatctgtaagtactgtgcagccaacatgttcttttttgtccccaacttctgccatctttccaacctctgaggcatgctattttatagtggtttgctctttgaaaaattgtttttgtgccctctcttaatagtcacagatactgacacaaaacttaaaaatgaccagaaaacaatgtataaattatttaaaataaaacattctttttatatcacattatcaaatttgtactctttattcacttttccattaagtgtgatatcaatatagctaggctgttttgagcttgcacagtctgtctaccaagctccttcctaagtactttgagggtaaaatgaagaaggcagtctaggaaggaacacaattacagagccctgtagaaggcagactgcttacaggagctgtataaggaaaattaagcccaacattatgtgctgtgttggccatcatgcaaagctgattgcaaagccctggttacctccttcatcatcttccatggaagataaaaataaattcaaatgttaattcaatagacatgatgctttataatgaagaagtttgtagcagaaacctgagaatataggtatcttcttaagatcaagagaggctttgtgaataactgaccttctaagcaggtcttgaagaatggagacaatggtcaaatagtagtgcagggagaaatttccacctagagtaattaaagcagatgtaggctcagaagatcatctaattgagctggttggaacatagacaggagacatactaagtatatttgacagagtaggtttgagtttacatcatgatttctgagtgcatggaatactatccaaaggaatttacactttattcaagggagaatattttaagatctcagcagaatggaacttaagatttctactttcagtagaagcctctgacaggtatgtttgctaaattgaatgggagtgaaatacagtagaatcaaaacagtgtagaaacaagacatgagaaagagtaacgggcagattgttagatgtccaggaatatttgtctggcttttttacttctactatactttattgtttcaaggtgatggttgactagcgaacatactgagggtcacatgccaaacaccattttgagtgttttacatgtaatttttttccttggtcatcttagcaattctatgactaattaataatatttgttgttatttattgtacagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcctataatgcattataaaaataaatcatttttcctaaa

SEQ ID NO: 20110 - DNA, 1849 bp, Homo sapiens
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgaataaaaggcaaactccttagcaggatctacagagtgtttcgtgatctctccttctccatcatctcatctctggatgctgtggtgcccagaacgttgatctaacaccatcttgaagcacacatgctgatctccaggtgcaccacgatttgtgcccttgaaaatgctgtttgctcaatctttctggagaaagtttgccacatattcggacttagtaaattagaactcctaccttgaaacccagatgaaggttcaattttccccaggattcctttcctcaccattctcctatgtgagggacttcttgtattataatcttttaatataatattatattttatgtaatattgtgttaaattatattgttttatgtaatatattattttaaatgttattttatatatgatattaaaagattataattatataatctttttcgataatttattcttgtattacaatctttttattataatagtctccactctccccaaaatattgtgaattcttcagctgaggagttttgctttagtttcttatcgccatggactgggaattaacatgtatttaacacattttgctcaaacaatcaaacagtaaaagctgaagagagcgtattattattcgcccattccgagagaaagttgaagatgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaaaaatattgtccgaagctctaaataccagagtattgattttaaagtctgccaagacaataatacaagtaacacaactaagcctttctttaaataataaaacgagtatctaaa

SEQ ID NO: 20111 - DNA, 2357 bp, Homo sapiens
gggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcctataatgcattataaaaataaatcatttttcctaaatcatgtgtagacttcattttatgatcgacatggaacaaaagtatcatctataaagagtaacaatgtagagtaacccccctcagaacttgtccaccataaaatatatgactttccaaatccaa

SEQ ID NO: 20112 - DNA, 1205 bp, Homo sapiens
agcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatggtgcggagccacctggccccactctggcctttcttgggaattctggctgaaattatcatccttgtggtga

SEQ ID NO: 20113 - DNA, 2444 bp, Homo sapiens
cacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtg

SEQ ID NO: 20114 - DNA, 2098 bp, Homo sapiens
cccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaggtg

SEQ ID NO: 20115 - DNA, 858 bp, Homo sapiens
cattcgctgttgggtcttctgctagggaggatgtcgggttcgtcgctgcccagcgccctggccctctcgctgttgctggtctctggctccctcctcccagggccaggcgccgctcagaacgccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttc

SEQ ID NO: 20116 - DNA, 1373 bp, Homo sapiens
agcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgttccaccgaggaaaaccaactctaccaacaatcacaaagataaaaacttgcgccagagaaacacaaattaa

SEQ ID NO: 20117 - DNA, 1234 bp, Homo sapiens
agttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacatacgttcttttcaagacttcctcatgaatctctcaattataggaaaagttattgtgataaaataggaacagctgaaagattgattaatgaactattgttaattcttcctattttaatgaatgacattgaactgaattttttgtctgttaaatgaacttgatagctaataaaaagacaactagccatcaaaa

SEQ ID NO: 20118 - DNA, 1118 bp, Homo sapiens
tttttcatctgtgatatatatatcatttatatatttctgccatcattttaatttccttgctttcttactttgctctgtgtgtacacacataagtgcatgtatatgtgaatataactattgcattttattaaacagaagttatgagatattggcagtatacaactttgtgaactgatgttactaaataaataacactatatttattagactggagtagcaattagaccctaaatgtgatggtttagcacactaggaattcatttcttgctcatgtaacacaagttttaattgcaggggtttttttaatatatttcagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttttatggaattgaaagaaacat

SEQ ID NO: 20119 - DNA, 801 bp, Homo sapiens
atagttcactcactttcaaagccagctgaaggaaagaggaagtgctagagagagcccccttcagtgtgcttctgacttttacggacttggcttgttagaaggctgaaagatgatggcaggaatgaaaatccagcttgtatgcatgctactcctggctttcagctcctggagtctgtgctcagattcagaagaggaaatgaaagcattagaagcagatttcttgaccaatatgcatacatcaaagttaatccaggaagatattcttgatactggaaatgacaaaaatggaaaggaagaagtcataaagagaaaaattccttatattctgaaacggcagctgtatgagaataaacccagaagaccctacatactcaaaagagattcttactattactgagagaataaatcatttatttacatgtgattgtgattcatcatcccttaattaaatatcaaattatatttgtgtgaaaatgtgacaaacacacttatctgtctcttctacaattgtggtttattgaatgtgatttttctgcactaatataaattagactaagtgttttcaaataaatctaaatcttcagcatgatgtgttgtgtataattggagtagatattaattaagtcacctgtataatgttttgtaattttgcaaaacatatcttgagttgtttaaacagtcaaaatgtttgatattttataccagcttatgagctcaaagtactacagcaaagcctagcctgcatatcattcacccaaaacaaagtaatagcgcctcttttattattttgactgaatgttt

SEQ ID NO: 20120 - DNA, 4132 bp, Homo sapiens
caagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaggtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctggcggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaaggtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtggctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacagggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagcccccatgacatagtctgctctgggcggaagagctttgctgccagccagggatgtccagaggtcagtgcagcccctacccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaatggtgtctctcaggatggtgctctgagagagggcagagtggatgccccactgccctagaccctcggtagacgtggggtctctggggcggggtctgtggctgtgactgaagtcggcttttcccgttgatgtcttgatgctcctatctgtgcacttaccgtaggtagggacacgtgtccacgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtgga

SEQ ID NO: 20121 - DNA, 1315 bp, Homo sapiens
tgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtgagactgtgctctgagctgggcaagaagaggggagagggtgcagaacgggagagctgggtgggagggcccctcaaggccagggtcagaggttagcagggtatcagtggacatggagagggaggaaaaaaaagagagagacacagaaagaaatggagagagagggacagagagacagggaggaggcagacagaaagagaaagaacaagagatacagtttacatgtatacaaagtagtatatgtatagtacatgtataaaagtagatctcagaagtgggaaaaggaaaatgaaaaagaatgttcatgtttcattctataatggaaaagatcccgagataggagaaaaatactttggaatgccaaaaa

SEQ ID NO: 20122 - DNA, 3190 bp, Homo sapiens
aacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 20123 - DNA, 3040 bp, Homo sapiens
agagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 20124 - DNA, 1041 bp, Homo sapiens
atgaacggaaaaagaaacggggaaggtgggaagaggtggaaatggaagggcacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttga

SEQ ID NO: 20125 - DNA, 1068 bp, Homo sapiens
atgaaaaccatccagccaaaaatgcacaattctatctcttgggcaatcttcacggggctggctgctctgtgtctcttccaaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttga

SEQ ID NO: 20126 - DNA, 1607 bp, Homo sapiens
ggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttgaagtgaaaactacagccctgaccccttggaaaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaa

SEQ ID NO: 20127 - DNA, 2701 bp, Homo sapiens
gccctttcctggcggctgggtctttaacaccgcccagcgcacatgtcgggggaggcctggcagctgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttg

SEQ ID NO: 20128 - DNA, 2609 bp, Homo sapiens
caggagagaaggactgagacgggaatgtggaatgcactgggcaaatggtcactgacacagagtgcagatgcctgcttctgggactcaatgcactgcaccctggtcatctgcggactcagcctgagcttccagagggcctaggagcagtaagggagtgagtgggcaactcggcgcatgaaggaggccgccctcatctgcctggcaccctctgtacccccgatcttgacggtgaagtcctgggacaccatgcagttgcgggctgctagatctcggtgcacaaacttgttggcagcaagctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagagga

SEQ ID NO: 20129 - DNA, 2432 bp, Homo sapiens
acagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 20130 - DNA, 4057 bp, Homo sapiens
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagcc

SEQ ID NO: 20131 - DNA, 8226 bp, Homo sapiens
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatata

SEQ ID NO: 20132 - DNA, 3708 bp, Homo sapiens
cccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggctt

SEQ ID NO: 20133 - DNA, 6646 bp, Homo sapiens
aagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattca

SEQ ID NO: 20134 - DNA, 8178 bp, Homo sapiens
ggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacaacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaaggcaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatata

SEQ ID NO: 20135 - DNA, 5560 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattt

SEQ ID NO: 20136 - DNA, 5608 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattt

SEQ ID NO: 20137 - DNA, 1791 bp, Homo sapiens
gagtgcgcatgcatttttccttccacagaaaacatacaaccatgtttctgccaacgtagttgaccaagataacctgttttttaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgatt

SEQ ID NO: 20138 - DNA, 7111 bp, Homo sapiens
gcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattcatctc

SEQ ID NO: 20139 - DNA, 3979 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaattaaaaacctgtgcaccaggagcatcttttaaatacactagccattctcttgctttacaaaaacaacctaaccatcacaagaaagcctgatgaagtccagccgtgctccagcctcactttccctgcttggaagcgtggggtctccctggctctcccaggataccatgctgtcctcttagtgacctcgtcgccctgcaacctccagtggggaagagtcacagagagcacctaagcagaggtggagacggcgcggtaagaggagggggagccaggctcaagtattggcaccaagttaggtctcagaggaaagaatggaaaccaatcactttacatttttatttttattttcggtggaaaaatcatccttttttgggacatacttgccccctacttcctcttctctctggaacggctcacaatgagtgtgacattagaaaactccttgcagaggagagtttctccaggctcttcctgggcccttagatctgcagttccgacaagctttggctgcaggaggttttacccatgaactggccatcctactaggaccacaagggaccaagggaatcagggacaaaggcccttcctgccagcccatgatcccgggattggctctcttcccctacttccacttattcttgactctgagaacttttggaacccaatggaatcagcatttcaaggtcaagatgaactgaaggggaagagaagtaaaacttggcctcctccagcccctctcatggcaccaatggaagtgtcctcctgttctctggtcaatatgtgtgtttactttgcttgctttgactcatgccttactccatggccaccctctcccaaagagggggctcgcttcccccattttcaacttgatccactgaggagagggaagggggtgactttcccttcttcagtaggaaaggcacatttgtagggcctgaaactctcccgtatttgctgactcattggtggagtagacttctggctcccagctccactggcccatggggcctccattgtatgaagtcagcataggctgcccacctaatggtggagagcatgaaactgggagcatcctgtggggggcttgtgggggaaaaaggtggttgttttaacccaccgttgttttggggtggtgttgcacactagtagagaatagagtctatgcctttggcaaatttaactgggagtttggattcccacttaagggttttacttcttgggtcctgtggatggtggttcttcgtgtcaggatcccagcccgattctgcaaatgcctccatggggtttaaaaacatgaggctttccaagttcttgcccagtatctggggcagcctccagagtatcacctgggagttcaggttctctccagggctccaggtgtgtgtttatctcgccccctccagctctcctcatcctgctccccattgctccatgtcaggctgttccccattgtgccctgctgatgctttgggtccagggcctcctcccaagtgtggctttaaggagtaagcttgaggatgatgttttttaattattgtaaatcattacctcatttccagcctcccaggctccatccatcccagcatcttttattctgccattttcctcaccttgtgctatgacaatggggcgttgtgtttccacagagacttataggagtgttcagtgtatagtttcttaataaacactttattttctaatg

SEQ ID NO: 20140 - DNA, 2088 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagcagtatctccagccccaagagccaccagcagggttaa

SEQ ID NO: 20141 - DNA, 2784 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactg

SEQ ID NO: 20142 - DNA, 2802 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactg

SEQ ID NO: 20143 - DNA, 2826 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactg

SEQ ID NO: 20144 - DNA, 19984 bp, Homo sapiens
ggctcggagcacttgtacatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccctgtaaggcagtttggcaaatatatatatatatatatatatttatatatctaactatctatcaatctatatctacagagagttaccttctctagtacacagagaagctgctgatacagaaaaccacaagactttaacaactcagaaactctaaaatattaataatacaaaggaaaattccctttgacttaagctgtggcccatgcttctaatgctacggctctttggagcagaagacctggaccatgcagagagacaatctttgggatgagagctctgggacgggaggagttaaggtggtgctcagtcgctgctgtgtgtgtctgttaccccggaagctcaccacaggcacatgtggggactgcatggctgtgctcagcaaagaaatgatgcctgagcagggtccttgcctccacttcttccccatttcctccacttcaggacaatgttctaatttgtccattctaaaaagtgtaatcttgatgcttttgggaatcaatgatggcacctacgggtaaacacagaacagacaaccccacaacacaaaaccatgacaagagctgacagcatccatcctgggtgtaagcttcttgctggagttgcaaaggatgtgtctttctattctcagaacttaaagaactggactttctggagtaaaagaaccacagaagaaaaaatagctgaaacctgaaccctgccaagacactgccacctgtcttttccatcattgcaaagattccttggcctcacctcccactttcaggcccctgggaagcttagggggttaggaaacaggtccccatgttatctttgaatgtagacacagcacgctttagggttgcaatagcaagagacttggttgcttgtaggtcattataacgaatgccccctggtcctctcagtttctcatcctgcttccctagatcctagaccccacttcctgggtctctactgagtcccaggtaaaccccactgccaaggaagggagccaggtctagtgagaggctgcagcagtgagtgtttcaggaaagcaagcagtggagtgggtgagagccagcaggggagaatctacttggcacctgtgccaggccccttggcattctcctcacgtttccagcccctgggaggattgatgcatctgcctttgagctgttgtgaaaacgcaggggctgagaaatcacttttgtgggctggggtagggggaagggctgaggcttctctgggagatgtccaatgagcggccagtgctgcaggcttggaatcttaatgaggcctgagccctgaccggagagagggaaggaaacatctgtgctggggcctgctccctctgccccagcactggggaatcactgccttcctggctgctgccacataccacagtggggccgacctctgggcctccctgtcacatgaaacatggaagccaacagcctggccccacagatctcctctgctggagaggagaggatgtgttcctcccaggccacggggcccctctgccttgccccaagcacagagctacctaagggactgacctttgccacactggagctcacctcccgggggcctctggcctacccttttccctgccagctgaagagactgccggcagcctggacgtcctggttagctgaaggcagctgaaatgtgggcctccctatgtggggtttagtactgaattatgtgtttgtggttttgcttctttttgtagacccacaaatatttttatttgaatagtaaagagctgtgctcagattgtagccatggttgggatttgggatcaacgaggctggttagctggactgggaggggaggcaggtgagatgggaatttggtgttggttttctcactgtgctgtgctcctagcccctgaggactttgcaggaaagctgtttggattgaccacctcaaggaactcctttgctgtcctatgacaattactcctcttgtctttccacctagaggaccgttatgccggggctgtgagttctggctgaagctgcacaatctggctttgatctgggtagctaagaacaggtgttcagggagggcatggtctggaggcgcctgagggaaaagtatcttctggttagaagtgaagcaccaatgctcctgttgcttcccttctcccatatcctctcctgaacaaacactgtgtggcttctgtcttcttggctgtgtgtttcaaaactgatagtcactgatgggctgggaagaagcaggagaagaactgggttggagatgggtggaaaactgggaataaggaccatgctatggttttatcttcagggcactgattcatcatggcctaatgaaagaaggtgattccttgggggaacaagaagcactgaaggagaccgcagttgtcagattgctgccaccttaggcccacgggctttcacgctgatcttggggtcatgttcttactgtgtccattgtaagcagctggctgtggaagagtgccagagagagaggggcagagcagggaagggtagcgagggaagatatattactttgatatattagccttggcagattaaaaaaaaaagatttattttggagagtaaaggaggcagaaaatagggccatggaaattgcagggtacactatggctctggggagtgtggcatgtactgggacacacctgtccctcctatattgggacaggactgataaggcttagtacactgtatcttaatttccccatctgcagaataaggggtacacctgctaatctctggccccttctagctctgagttcttagattctgacaacgttgtgtcactgtgccatttttctcaataccattctggaatggcaggacagccttgcataggtggggggcagttgccgctgaaggctcactgggcctgggcaaggctgagttccaataagacactcctctccttctttgccccttgtctcaacatttcggagtctgaagtgtctgagacgactgtaagccaggaggggagcatttggtcggcttcccatcctggcattcctacataccagaaaagcactgtcgacggtccatttatttatttatttatgaagagcctaatgtgatgaaatgtgttgtgaaatgacatcctattagccaatatggccactccagttcatttcaccctcattttcccataccaaagtccaccttttagaagaccatgtcacatcgcctctgagagcttagctttgaagtgagctcttttgtgtcttttgatgaacgctccagggcacccaggctggtctctctgccatgccaacctcaccggatcctctcctggactgagtgagagtgacctgctgttgggtgtccaccttggagtagggtgttgtggccatgggacctcccaattcttctttctttggatgtgaacctaactctgccctctaatgatatccctgaactctgaggggaccttgggcatcactgaacctcctctagtcaagagacaagaaaaaggaggtgctgcttcctccattcagcagatcatgcacaaattactcctagacagaggcttcccacttgaggcaaaggatctttggtccttctgggttcaggttgaacattaatgttcttctctagtgatgcctactttgcggaatacactagtgcaagtcattttggtgctaaatactgcagaaaccaacaccaacgggagagctgtcagccagcttctggggctgcacgagactcaactcagaagtagaagtgagtcagccatgccgggagagtacagggtgcattggaagttaagtagaaaagtggcagggtgaaaagaccagcaaaatttctgattttgctattagttatccacgtggccttggccaaatcagcttatttctcatttgagacgtttaagaggtttgtatagatatttttagagtccttttcatttttttaaagctaggttctggtcccacctgatatatatgtacttgcttgttaaaaataagagatgaagtgaaagataaggaaggagacgaagaaaagttaccaatggcaaaggattgattatagaagacaatgaaagaaggcctggtgactggtagatttgaggaatattgtacagggagccaggcagacaagccagagacttcatttttatgctcttcacaggaggtcactggcctagccacttgcctgcgtttcaccaggctgttcccctcagctagtcaaccttccctgttcaaaaccaacatgctaacacttggcagaaactattccaagatatggagagaggcctgcccatctctcatgcaggccactggaaatcaactctgggtcaaaaccgacaagatttttatcttttaatgcttattgtaagaggccgggatgtttgaaagagggcagcgtcttaagttgcagactattcaccaaagtccttttctattcaggaatgactaatgactttctttgttccccttttccaaaccaaacagcagcagtattaccttgactccaaagtacagtgattgcaatggacagtcttgagattaagggtctttttagtgctttgctcggaatctggagcaaggaaatgtctagggatgtttgttgaatgaacccacctgccagcagtccagagagctgtcccaaaggcccctgagatgtctattgtctgctttggtagggagccaacctgctagaagactcaagggcatttgccttagagagaaaaaaaaatggcacatttagttccgggcttgggtgctgaagtcactgtgtttttggctcctgaagctccactttcttttttcataccaaataaattgttttggccaatatttaaggatttaaatatttaaggttttgaaggaaaattccaagtttatgcatcattattaagacatcaatatgggcttgggaaaatgttttggtgttgcttaataatactgggagtgtcttctaaagaaagtatacatatatgtacgttgtgtgtttatttctatatattggattggaatggcttcaaagaaggcctgtttgaagtcagcaaattgatttcaatttgggattctcttttagccttaccgttcttggggataagaaatctggagatgaactggcctcagaaacattcaggaagattacgatgggaaatctgtcatcttgtaaagttggatcatttggtgctctctgaactaaattatgctgactaacattctgagcatctgaaaatcattcttcctggttgcctgatagatgaccacacaggagtcatttctatcacatcttatttgggggttggtatagacgccaccagcactgcagggaaaaccaccccctaggaggggtgagacagagagaatgtgagattttgatcattgattgctctttctgaaaggcactgctgaccatagtaggtgtggtgaatgtttgtgtcactgcattgggtattagaacttttgctctgagcatgggctgccctaccctgaagagctgaatcttggcttctgacagaagctctgcatgactcattctcctcaagcatattttccttattttcctatgaaagtatctatagtttgcaacaagaactgtctttggttcaagtgtcagtgtactagaatagatgcttttctgtgagacctgtggaggttggattggggtggggggtgttccttcaaagtacttggaattctttatcaaagaaataaaactcagattctcttctttctagtttacttctaagttccaaatttaaaacaagacccagtttgacatttgcagtaggagataatgtcttgaaccagtgagcttggctatctttctttcatcatagggaggcagggcagtaagttgtattaatttttcctaatcacccaggcaaatattgctttttgttcagtgtcgtgacccacattcatagcttgcaggggatacttctagctgacaaagctggaagtttctaatagaagatgtatcaagataacagaggtgaggaaaggcctgttgaacatctacttctgagaatcattgaggcactcaggtcttgcttttcagtttagtatcttacaaaaggagttggtttcttctcattttagcaatgataaatttagacatcttttttgaaaggccaaaggtagattgagagctcaaatacttacggtgtactctgacagtcttttattctatttttcaagacttattttatatatacatattttttatttccataggttattggggaacaggtagtgtttggttacatgagtaagttctttggtggtgatttgtgagattttggcacacccatcacccaggcagtatgcaccatatttgtagtcttttatccctcactcccttcccacactttccccctgagtccgcagagtccattgtgtcattcttataccttgacatcctcacagcttagctcccacatatcagtgagaacgtacgatgtttggttttctattcctgaattgcttcacttagaatagtggtctccaatctcacccaggccgcttcgaatgccattaattcattcctttttatggatgagtagtattccatcatacatatatatgtttgtgtgtgtgtgtgtgtgtgtgtgtgtgtgtgtgtgtaccacagtttctttatctgctcattgattgatgggcatttgggttgattccactttttgcaattgcaaattgtgctgctataaacatatgtgtgcaagtatctctatctcttatgtataatgacttcttttcctctgggcagatacccagtaatagggctgcgggattactgacattcttttacatgcaacatccctaaaacccaacaagacgtgtaaacactgaagtccaagtctgataattattctttcatttaagaagaacacatgggagtttcacatattatttttaaaaactaattttgtaatatgttaaatggtaggacacattcaattttttttcctcattggagatctgtccatgttctgtctcaatttaatagctacctggcatgtaactgatgcctctgagcctacctctggagtgaataaataaacgtggtccaggtgatttgatttctgccatttgtagtggagaagtaaatctcagtgaagaagattttttttcatatttcttcttttttctttttcttttggcttctatcctcctgcttccatgggactgacaatccagcttctcaaactccacgaaagtcttaatacaaggtgaatcccagagccacaaacagtttggacttcaaacagtgagaaaattggaccgaatgattcggcacacaaagcagaaaactttcatttcctgtaggcaggatggaattgactgttatattaagacttctgaagaagccctgccctggagtaatttcagtgctgtcagacgatgttgacatctagattaacctctgtgcagtgaattttactgcaaagctcattgagatgcatgtgatgtgtctccacaaatcccatctggaacccgtggtggcccaccctcagcaaccctcctctccccactgactctgctttctctgtccataaacttttagcctccaggagcagaggagccgtggctgagatctgaccctaggagagggagtttgggccttctctgaccatgatgctgagccaggctttctgcttagagtgacagagattgtcattgtattgggtttcccctgagggaactgcaaattaaggcatgaaaaacactctgctgatgacagtttcacagcatatcttaatgctgcacaaagtgaaatggtttaaaaggaattagtgtgtcctaagtcattgagccctgctctgggctctgcaatcctctagggattcaagatcccattgcaacaaggtcatgactgcgtctaggccggacagacggattctgaaggacaaggtgtttgtcttttgtgcaggtctttcctatggtccttacaagagaggcagccacagctcctgtttctcccaactgggacaaaagatgtagctgttttctaagcactggtttgtcatctctttaaggagtggttggctccagaatgagccagactcactctataattccacattgtggcacaacagccacatagaacctcaaagctgaaattgcaacttttctgcaaaatagggccattgattacatccaaagttttgagaaaaggccttcaggttagattcagtcaccttcagactccacagagttgctcagcatggttgcaggcgtctttggaaacttacctcagggttttagaatacgttaccctgaagtctggataacaattttctctgagattttactgattctaattccctttgaaattgtttttcctacttgcctcttgtctttcatttaaataataagaatctccttgcatattcttaggtatttctttaggagaattggaagtttccagccaaggacactgtgtttatgaattggaaagatatctttctgggctgaaaaaggtaaaaatcatacggaggcaatcttgatgactttatttaaaagcaattatcagcattgtgttttattctaggtgctcgtgctcatagtgcaaactacattcacgtttttaattatttatgttatgatacttattcgtgtgtacatatatgcgcacacacacacacaaaagcctccacaatcctactggtatacaaatccatatgccccatttgtgtcgcttccgttgatctttgtgtgcatgcatttgcaatgaagtgtgcatcacatgtgtgatttcttaaagtcatctatagctcatctttcctcttattatcgacacataccctttgactttctgcactttggagctcatgaaattaaggctttttcaagggagactacatcttgagtttctttaaaccttcatatttaaagataggactggttttcttcgagaaacaaaaacttgattcagattttatttaattaattaattttctgggggaaatggtactgaatttgttcctgagtaacaaatagtagtaagtgcaaatataaatgtgaagtagtttaagcaggttattgaacctatcttgtggctgaaacaagtagtcagatatgaagctcagacactcaaattgaattagaacgtgaaccaaaacggttagcatggggcaggagaagagcactgggctaggagcaagcctgctagattgtcacttgagtgtccttagcttaatgtgggcatctgacaactagttgcagtcctgtgcccctctaattccagagatggggcaagccaatctgtttctcatccattgctcaagttggttatcactgaaatattatataccatctcaagatcctgccctgaacaagtttgcaaacatcccccccacactgaggagtcagtcccatttttgttttatggcagtttatctcttgtgaccctcctttggaagctgtccaaactctgaacacttgctgtccattccctgctccccaccccaccctttaaggccagggaaaagccagggaaagccctattggctcatctccctctttcctagcctgcacatcaaccaagcttgggatttagcctaggttttcagagaggaaaacaagtgcgttctcccagccatcagtatctttccagccccctggaccaagtgattagtgcctcattagcgcctcatcagttgcttttgcacaagagactctgggacaacaagcctattataatgcctcagtctgtctttttgaagtcaaaccatccttctggcttggttaggaaaggggagcctttctccaaacacgttttcttttaatttcctctgttgttttctggctgttaactatatggataaatggtaaaacataattttcattttttctaggcccctatgagagtggatatgctatatttctatagatgaggagttccacatgtcagcaaagcatttatttatttagtgaagtgactataatattgacacacagatttgcagcagcatccaaatcttgagggggaaaaaaaagcctttttcaatcaaatgaaaccttttctgtgatggcaccagagaggtttatatcttaagcacagaactgaacctgataatatgcttcctttctagaaacaaagagatagaagaaattgctgaaggagctggaagaccaaaccatctattccccaaatcattatgtatcaatagatacttcaactctgttccttaaatggctctgaaaaacacaaataaccatatttactattaaaaacaaattcataatgtctaacccaatcccttattttaatatatatacatattaaaataatcccatgtatatatgattattattatatgggatatatatagtttacatatatataggggtgtgtgtgtatatatatatatatatttacatatatatgtaaatgtatactttttaatgctggggatagttccatattgtttcttttcttgattccttctaatatattcaatgagatttataatttttttcacttttatttctttaggaaagagttggggtctattatgaatgctttctaggataaaatggcaaaacagatggaaagtgtggtagagggaggataatgggaataggaggcagagaacttgcacatttctatttcctgctgagagatcttggaaaaacattgtctgccctttacctcagtttcttaacatacaaaatagaactactatcaaccccctgcatgccacagagggttatttgagccctaaatgagatcataactgttaacatactctgtgaactgtacagggccagacaaatagagcccactctctgggcagttgcatacagtcttgctgggtgctgagctgagtgactgagagccgcttttgagacacattttgaggcatatcttccctaaatttttgctggtgtctgttttttagaagttttgccattagcattttttgctttgagtatctagtgatggagaatgctctaaaaaatacaaggagacagggggattctttatctatttggcttagtcactggaaagggacaattagagtttgttttcaggcttggaactctgacattttgtagcaaaatggcatcttctgctgcatttaattccttgccatcaactcttgctttcataaggttctgtcaatttcaacataatgctttgtaaaaataggactctgtgaaactttctctataaatttggtggtataactaatttttcagggagcatctgaagggataatgatttttaagtggtaccctgttcatgccaggaccagcatttgtacatgggaaaataatcttaagatgagtgaagagcaaatgctagaccacacctttaataggcccaagtgccaacaaaaatacgtgtgagtgggattcccacggagaaatgtttctgaatgaaaatgaaacccttgataatgaatcctgaggccagaatgccaaagtcacagtattctgtcatttacagcccctaaaaaatcccaggtgtttgtgatgacaagccactattataagtactctgtattagtgactacttggcaagtaaaattttctcaaatgttatttttcatagatctccaagcaacaatcacttgcagtgtatctgacaaaatgctatacatgattttctaaaagtattttgatcactccagaaagaaatcagaataaagctgcataccccaaatcctagaaaattcacaaatattttgctcaagttcaggctctctcagcttctcttttctctttaacttttgcctcatacagaggcaatcttgatgacaaaagattgggctcaatttttgtttttcttgtgtagaaaagcaacacctctgtttcggactactgttcagtagacaaaaagcatcccagctttcgaaatgagagtccaaattgggttaccactgagattttaaattatgatgtgaaattggagaaggtgaactgtacagggccagacaaataatagagcccactctctgggcagttgcatgcagtcttgctgggtgctgagctgagagactgagagccgcttttgagacgtgttttgaggcatatcttccttaaatttttgctggtgtctgttttttagaagttttgccattagcatttttcactttgagtatctagccatggagaatgctctaaaaaatacaaggagacagggggatgctttatctatttggcttagtcactggttcagggtgaagtttcataatttattctgataatctggaggggatgacctccttcacagtactgttaaagccttccttgaacaagctcatttcactatataacttcctaaagacaaggctgattatttaaggatttcagagatatcatttggggaataactcaccaggtagagaaagtttgacctgatatgttaacaggcacaacaagaacttatttcaatgctttctcaccatctgccccttctctgagagtttagcctttcttaggatacttccttttccaggctagaaaagattgattgtattcatatcccaaagtaaaggctcctccaattctatcagatgtggaggcaacagaaaatgactcatgttatttttctctcacttcacagcatcaagaactcttcttgtttatgtgggggccatggtggattagcttgaggaactgtcaaattaaaatgaaaggaaagcaagttggggcaagaaaattctcactctgaatgtgaaagaaaatagcagtgttcttctctctggcaaagatttgtgtactgttgggggaagattcatgttatttctcaggtagactttactttttgagattctgtgtgtgtgtgtgtgtgtgtgtgtgtatgtgtgtgtgtgtgtgtgtattttgcctggtggggggttaaaggcagatagaatgtagttgtttatgagtttatactttctctttagcataatagatgccctgtttattttctcagaatgtgacaataaaattaggaaaggagaggaattcagaggcccatgttgcagttcatggcaaagttttacccaaatatttccttcagaaacatttagtcatagcaagccatataaattattgtctgcaactggtatcagaaaaagaaatcagtaggtggggactgtagaccccaatggtgcatctgtttacaatctttcttttccaaggttttaaggttcatgaataacatgagggaattttgggagagctaccacatcagtactttggcacgcattaactgttccacaggaaaactagggttgcttcagggctatttttgtttgaaatgacacacatacaaaaaaaaaaaaagacttttggaacatgttttgaggcctgtcacctgaaatcagcctttgctgaaagagtatttagtttgataagcgggatttcttgcttctcgcatcccagagtgtaaattctgcagcgaagcctgggtgtatgttttcagcaccagggacagcaaacaaccccctgaattgaaggggcccgctatcctgattgacctcccagactaggaagggcagttgttttgttttcctttatttcctatctaccggagcctcaacttggaagactttattcttaaggttcttacatctttcatttattaccaagcctagcttagctgtctctgtcacattcttgacctcctaacaaatgggtttggagtaacactcccagctctcctggctcagagaagtagaaagaaacacactagacttcatttgaagggcatgctttagagtaggctccccctacacaagtctttataacataccactgacttgtaaacccctaaatgaaggactgcttatacacaatcattttccttttaacatttctgcacatttctcacaatgtacaagtctatgtttgactcagtgtgcatctggaggcaatgtttcacagcagttgagcagaagctatgaagtttggggacagaaaaggtcccagtgatgctgctgttattcattttggagactcattgggggcacttctctgattctcagcatccacccttcaaccctgagtgctctttaacagctgtttttgccttaaacaatcacaataagaatgcaaatgactccttgtggcattcttcaggccagactgaagggtgtactgagaaaacaagggtagcagaagcacatgttgtcacattgctttgtgattggccagtttttatatagcacaatgacacacagatatcatcttagagtcatcattgtctactcttaactaattgtcagcatcttctccactcatgtcaggatgaatcctgtgttgggaaggcaagtcagtcactgcaggtttcatcataaatattgccttctatctgacagatgttagaaaacctccattttgaatgcctctgtaccatccaaggctctgaatttcccctatatcttatccctttctttccattccctttccatgttgcttatcataacatccataacatttagtggtgtaagaaaataaggggtttcttttaggaataaatgaggtggaaaaagtaggacagagccagatctcagaggagcaagttcagtggaacgatgatttctaacttgggagtgggtctaagatgtagccatccattccttccattccttgtcctcttgagtgaatctcattccagtgctcacacttgccctgcaaaaaaggccatggcacaagattctctagattatttgtatgaagactggaggtgagcagcatccaacacctctgttagagttctttagaatagaggagttttgtcttatattttaatccaggaaccttcccatatttaaaaagtttagaaataatatgtacagaaaggacctatggggataggaaagcttaataatacaagttattttcccttagaacagaggggaaggagctgcaaagtgactgctaatggaggaacgatctgctggctgggggaaatgtggcctgagactagagatgcagagcaggcatctctagaaggagagatgatgccaatagaagccccaggagggaactggccagcgaatacaattttataaagattctcagtactttttctgaaaaaattcctaaaattttcaagggcgcgtctagccctctgcctctttagaggtgagctcagtgctacttctgggttcttaaggcaaatgccctacaaacaccaaagtcttgtattttccactctcagccggcactggctaagtgggattttttttttcccttccctaagtgaaagggacttgttttcaggagaagtgtcctttaaacatccagctaaaactggaagtaattttttgcatgaatggctttttacagctaggtctacagcagaacaaaacttgtattaaactaagtgctactttacatatcttatttcaagggaaatgaaggatttattgtcgtgtaaatgatatacactgatttgtttcctactggacattacatgtccctttatctctaggctgatgttgtgcagcaaactttcaatatctggaaaatcagctggtacctacttcagtgcattattaggatattacgttccctgagaggaattttgccaatgaagtttaggtactgttgtaactgatttccatcccccctccctaagcttctgtactaagtatatgtaaagctattatatcttgtctgatcccatgtgttcatgtgtgtttcccaatgtttgcataaatatattggcaatctgaagggttagctggcttatggcaactgctgaacaatggtatgtttggcatgtgggacacctgatacctgggcacacctgttctgaggccaagctaattttacagattttggaaaagaaaaaacagcagcaacaacaacagtgtggcttgaattaaggaaagtttaacaatgaatacagtattgccaagtcatcatttatgggtggagacgttgaccacagcagttgaggtgctttcaactggatcttatgccctttattttaatcccaattgatagttcctcatttgtattttatgacttagaaatactcctacgtgatgctcgtttgtttttctcccaggcttctggaaagtgctgatcatgattgcttcctatcatttggatcccaaagttgataacttaacataagtgactgaggttttagtagaactgggttttactaatcgtatctcctccttgaggtgctgttcccttcattcctttcctttatgacaggtgaatgcattggctatgctgattttatttgcatcctggcgagtcttggagaatcaatctcgttaaaatgatgactgcatttgcctttggagaagaggtttattgtctaagtaaaactcttatgtgaaggtgtcatttatgtaaaaaaaaaaaaaaattctaacttgataagatggccacaggttagaggggtgtgttctcagttgatattaagggatatgttgaaaaggcaagtgcccaccctctattcttcatctcacccttcctttctccccaacctcaaaagaaaacaaaaaattatttttttaaattgtattagtaatttatgtttaatacaaaaggatgatttaatggtatcaccaaaggttgtttctcccattgtgcatgtccttcagtctcggccccatacccatcaccccattcttcaccctcatgcttccatcccaaggcaaacatgtgtcttcatcggaatctatgggtgttgaagttaaatgtgggggcagagatttaacaccatgacactaatacaaatcaaccattcttcactttcaaatggttaatcactacaggaaggcgaactcttttcttggtttttgtttaaaaacattttatacatatatatgtatatatgtgtgtgtatgtatggacataggtatgtatatgcacatgtacatgtatatatgtatatatccatcttcaatataaatatatcataagtgagagttgtaaatactccttggtcatatgtctgtctttctcatagtatcatatcttcaatgttatgttaacaactccatttattgattgatgaaatcgtgtgtagacctgtatcctcctgacatagtttatgtagggtctcttctcaaataaagtataaaacaacaa

SEQ ID NO: 20145 - DNA, 2123 bp, Homo sapiens
tcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtgggtcttttcaaacatagacaatcatgggatattaaacttgaaggacaatagagatcatctagtcccatcaactcactatatatatgaggaacctgaggtccagagtggggaagtgtcttacccaaggtcacatggtttcagagaaattatgttgaatccaataagccttcccggacattccaagcctcttaaccatggcatctatgttgaggatgtcaatgtttatttcagcaaaggacgtcatggcttttaaaaactccttttaagcctccttgttttgatgtcaccttggtaggctgggccctctgagaggttggaagctctaggcattgttctctttggatccagggatgctaagtagaaactgcatgagccaccagtgccccggcaccctttaacaccaccagatgggtgttttcccccatccaccactggcagggttgccccttccctccaatcatcactgtgctccttttttcccggcctacgaggcagctcctgccactatctttagagccaataaagagaatt

SEQ ID NO: 20146 - DNA, 2287 bp, Homo sapiens
attaagctgtccacattcataaggcacactccaggtctgcaggagggagcatgagggattcaggggacgcccttgtcccctgtacacacctaggggccggttcgactacagtagacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggttgtgcaggcatgaggactgatactggggaaaaaagacggggaagatgccccataagaaaattctgagacgttgaagcatgcttatattggattctgtcctcgggaaaggagaggaaaaggctgaaggagaccattgaatctggtgttgagtcattcacgtctctctactcctgtggagggcccttacggatgtgtcataacaggatctccttttccttcctcaagtgcaaaaggccttttttttttttttcctgagacaaactgaatatataacataaaaagatac

SEQ ID NO: 20147 - DNA, 1167 bp, Homo sapiens
tgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatc

SEQ ID NO: 20148 - DNA, 1141 bp, Homo sapiens
gagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacgatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttc

SEQ ID NO: 20149 - DNA, 999 bp, Homo sapiens
cctaggtggttgccccctccctctcctgagatgtcaggaaggagggggccacctgtgtcctccacaggggccccccgaagcctggggactcccagccccagagctccgaggcggaggaggtgctgacaggtgctccgagagatgctccctctcccctcatgctccctccccatcctcctccttttcctcctccccagtgtgccaattgagtcccaacccccaccctcaacattgcccccttttctggcccctgagtgggaccttctctccccccgagtagtcctgtctaggggtgcccctgctgggccccctctgctcttcctgctggaggctggggcctttcgggagtcagcaggtgccccggccaaccgcagccggcgtggggtgagcgaaactgcaccagcgagtcgtcggggtgagctggctgtgtgcgatgcagtcagtggctgggtgacagaccgccggaccgctgtggacttgcgtgggcgcgaggtggaggtgttgggcgaggtgcctgcagctggcggcagtcccctccgccagtacttctttgaaacccgctgcaaggctgataacgctgaggaaggtggcccgggggcaggtggagggggctgccggggagtggacaggaggcactgggtatctgagtgcaaggccaagcagtcctatgtgcgggcattgaccgctgatgcccagggccgtgtgggctggcgatggattcgaattgacactgcctgcgtctgcacactcctcagccggactggccgggcctgagacccatgcccaggaaaataacagagctggatgctgagagacctcagggatggcccagctgatctaaggaccccagtttgggaactcatcaaataatcacaaaatcacaattctctgattttgagctcaatctctgcaggatgggtgaaaccacatggggttttggaggttgaataggagttctcctggagcaacttgagggtaataatgatgatgatataataa

SEQ ID NO: 20150 - DNA, 1103 bp, Homo sapiens
ccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtaccgtgcactcctgcagggggccccggatgcgatggagctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactgagataaagtgtggcaactcg

SEQ ID NO: 20151 - DNA, 4291 bp, Homo sapiens
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 20152 - DNA, 4687 bp, Homo sapiens
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcattttcccgtctcattttctgtttcccatttgaaaacagtgttctcttctcttctttctgtatgccaaattgccagccacaattctttcccaatcttctgcccagtggagtactccagctgtctttcctttagagaggtggttcagtggcctccttgatgacatttgtttcatgtctggatacagtatgtgttgccctcctttggactggctagaatattcataaaagccaggcaggccctgggactattttgggaccttcaatacacatgttaggaaaaggatgatcataatgccaagagtttgagctgaattgtttcagccaaagcatcactatcactgaaggcaggttctcaaactgaccttgtcattacaaataaatctaatttcacacttga

SEQ ID NO: 20153 - DNA, 4315 bp, Homo sapiens
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaagtgcgtcctggtcaccttcagatgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 20154 - DNA, 4062 bp, Homo sapiens
agagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttca

SEQ ID NO: 20155 - DNA, 3569 bp, Homo sapiens
ccggagtccccacgcgaggatgctgcggtgagcgcggccgggacgccgcgtcgggctctcggccgcccagcggcgccgcaggggaagccaggccggcagccgcgcgctccccagccggccaccaatcccgccctccccggctcctccggacctcctcggcaggcggcggcggggcctgcctgtgcgctctgcgcccgcccgcgcctaccctccatggcgtttatccggaagaagcagcaggagcagcagctgcagctctactccaaggagagattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgacgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaagaaa

SEQ ID NO: 20156 - DNA, 3371 bp, Homo sapiens
agtcggggccggtcgtggggacgccggccggagatctgagggacgggaggcggcgtgggggccgggcacggaggcaggggccggacgcgtgtccagggcctgggctgggggctgtggcggaaacctgaggtcggggtgagaggccgggggcctggtctgggccggagcctgccggggacaggaactggatgacgggccaggccagattccaccgcggagccgaggcatgccgagctatccggcagtgcaggtcccggcggccgcgggcagctcacccggaaggccgcgcggggtccgggcgtggatcccggcacgcgagcccgggcgttcgcaggggaggattttccttgctgctgcttaacttggaggagtactactttgaacagcatagagccaatcacattttgcacaagggcagtcaccatgaaaggaaaatcagaggctccttaaaaatatgttcaaaatcggtgatttttgaaccagattcaatatcccagcccatcatcaagattcctttgagagactgtataaaaataggaaagcatggagaaaatggagccaatagacacttcacaaaggcaaaatctgggggtatttcactcattttcagtcaggtatatttcattaaagaacataatgttgttgcaccatataaaatagaaaggggcaaaatggaatatgtttttgaattggatgttcccgggaaagtggaagatgttgtggagacgttgcttcagcttcacagagcatcctgccttgacaaattgggtgaccaaaccgccatgataacagctattttgcagtctcgtttagctagaacatcatttgacaaaaacaggttccaaaacatttctgaaaagctgcacatggaatgcaaagcagaaatggtgacgcctctggtgactaatcctggacacgtgtgcatcacggacacaaacctgtattttcagcccctcaacggctacccgaaacctgtggtccagataacactccaagatgtccgccgcatctacaaaaggaggcacggcctcatgcctctgggcttggaagtattttgcacagaagatgatctgtgttccgacatctacctaaagttctatgaacctcaagatagagatgatctctatttttacattgccacatacctagagcaccatgtggcggagcacactgctgagagctacatgctgcagtggcagcgtggacacctttccaactatcagtacctccttcacctcaacaacctggccgaccgcagctgcaacgacctctcccagtaccctgtgtttccatggataatacatgattattccagctcagaactagatttgtcaaatccaggaaccttccgggatctcagtaagccagtaggggccctaaataaggaacggctggagagactactgacacgctaccaggaaatgcctgaaccaaagttcatgtatgggagtcactactcttccccgggttatgtacttttttatcttgttaggattgcaccagagtatatgctgtgcctgcagaatggaagatttgataatgcagatagaatgttcaacagtattgcagaaacttggaaaaactgtctggatggtgcaacggattttaaagagttaattccagaattctatggtgatgatgtgagctttctagtcaatagcctgaagttggatttgggaaagagacaaggaggacagatggttgacgacgtggagcttcccccttgggcttccagtcccgaggactttctccagaagagcaaagatgcattggaaagcaattatgtgtctgaacaccttcacgagtggattgatctaatatttggctacaaacaaaaagggagtgatgcagttggggcccataatgtatttcatcccctgacctatgaaggaggtgtagacttgaacagcatccaggatcctgatgagaaggtagccatgcttacgcaaatcttggaatttgggcagacaccaaaacaactatttgtgacaccacatcctcgaaggatcaccccaaagtttaaaagtttgtcccagacctccagttataatgcttctatggcagattccccaggtgaagagtcttttgaagacctgaccgaagaaagcaaaacactggcctggaataacatcaccaaactgcagttacacgagcactataaaatccacaaagaagcagttactggaatcacggtctctcgcaatggatcttcagtattcacaacatcccaagattccaccttgaagatgttttctaaagaatcaaaaatgctacaaagaagtatatcattttcaaatatggctttatcgtcttgtttacttttaccaggagatgccactgtcataacttcttcatgggataataatgtctatttttattccatagcatttggaagacgccaggacacgttaatgggacatgatgatgctgttagtaagatctgttggcatgacaacaggctatattctgcatcgtgggactctacagtgaaggtgtggtctggtgttcctgcagagatgccaggcaccaaaagacaccactttgacttgctggccgagctggaacatgatgtcagtgtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccagatagtcgccatgtcctcagcacaggaacagatggctgtcttaatgtcattgatgtgcagacaggaatgctcatctcctccatgacatcagatgagccccagaggtgctttgtctgggatggaaattccgttttatctggcagtcagtctggtgaactgctcgtttgggacctccttggagcaaaaatcagtgagagaatacagggccacacaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaa

SEQ ID NO: 20157 - DNA, 1396 bp, Homo sapiens
cgacttcctctttccagtgcatttaaggcgcagcctggaagtgccagggagcactggaggccacccagtcatgggggacaccttcatccgtcacatcgccctgctgggctttgagaagcgcttcgtacccagccagcactatgtgtacatgttcctggtgaaatggcaggacctgtcggagaaggtggtctaccggcgcttcaccgagatctacgagttccataaaaccttaaaagaaatgttccctattgaggcaggggcgatcaatccagagaacaggatcatcccccacctcccagctcccaagtggtttgacgggcagcgggccgccgagaaccgccagggcacacttaccgagtactgcggcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctgtggagggggacgaggtgtccctgctcgagggtgaagctgttgaggtcattcacaagctcctggacggctggtgggtcatcaggaaagacgacgtcacaggctacttcccgtccatgtacctgcaaaagtcagggcaagacgtgtcccaggcccaacgccagatcaagcggggggcgccgccccgcaggtcgtccatccgcaacgcgcacagcatccaccagcggtcgcggaagcgcctcagccaggacgcctatcgccgcaacagcgtccgttttctgcagcagcgacgccgccaggcgcggccgggaccgcagagccccgggagcccgctcgaggaggagcggcagacgcagcgctctaaaccgcagccggcggtgcccccgcggccgagcgccgacctcatcctgaaccgctgcagcgagagcaccaagcggaagctggcgtctgccgtctgaggctggagcgcagtccccagctagcgtctcggcccttgccgccccgtgcctgtacatacgtgttctatagagcctggcgtctggacgccgagggcagccccgacccctgtccagcgcggctcccgccaccctcaataaatgttgcttggagtg

SEQ ID NO: 20158 - DNA, 959 bp, Homo sapiens
gagcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccatgacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcttggcaggccggggcggggcatgtctgcgtgttctgtctggatgggtatgggaccgtctgttcattatgaagtgggctcagagctgtgattctgtgagcatgtgtgcatgcatgcatgtgacctcattgtccggtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgagcccctggacagtcctgacgagacggaagaccctgagcccaactatgcaggtgagccatacgtcgccatcaaggcctacactgctg

SEQ ID NO: 20159 - DNA, 1039 bp, Homo sapiens
agcactggaggccacccagtcatgggggacaccttcatccgtcacatcgccctgctgggctttgagaagcgcttcgtacccagccagcactatgtacatgttcctggtgaaatggcaggacctgtcggagaaggtggtctaccggcgcttcaccgagatctacgagttccatctcccaagtggtttgacgggcagcgggccgccgagaaccgccagggcacacttaccgagtactgcggcacgctcatgagcctgcccaccaagatctcccgctgtccccacctcctcgacttcttcaaggtgcgccctgatgacctcaagctccccacggacaaccagacaaaaaagccagagacatacttgatgcccaaagatggcaagagtaccgcgacagacatcaccggccccatcatcctgcagacgtaccgcgccattgccaactacgagaagacctcgggctccgagatggctctgtccacgggggacgtggtggaggtcgtagagaagagcgagagcggtcagacctcccaccttacggggctccttcccctggtgctcaggaacccacagccacaagccccctgccaaggctcaggcagccttgcccctgggaggactccggctctgttaggggccctaaatgtcctccccacactgtgggtcgccttctgtcttagtgtgcaccctgtggtggctgtgggcatctgtgcttggcaggccggggcggggcatgtctgcgtgttctgtctggatgggtatgggaccgtctgttcattatgaagtgggctcagagctgtgattctgtgagcatgtgtgcatgcatgcatgtgacctcattgtccggtgtggtgaaggtgacatttccaaatctgagcattggacatcagtgtgtctgtgtccctgtgtcctcaccatccctgatggctgcagggagccgctgggccctgcccctcagtcacattcccgcacctctggcacaggttggtggttctgtcagatgaaagcaaagcgaggctggatcccagcgtccttcctcgag

SEQ ID NO: 20160 - DNA, 2226 bp, Homo sapiens
tctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaa

SEQ ID NO: 20161 - DNA, 2203 bp, Homo sapiens
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 20162 - DNA, 2543 bp, Homo sapiens
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggtaaggcagtcagacctcttgggagcccaggcaggctcagtgtcatctcggcagttgcagttagatgtggagttagagccaggctggagccaagtccctggctccaagttcagtgtatttgcgccatggcatcatgtgaggggatgggggctggatcttgtgtctatcctctgcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 20163 - DNA, 2276 bp, Homo sapiens
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgagaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 20164 - DNA, 2168 bp, Homo sapiens
acactccacccctactcgccctctctctctctgcttctttccttttctctctcatggtagggttatgagtcagttgccaaaaggtggggacatttcctgatgcatttgcaacactgagaagttatcttaagggaggctgggccccattctactcatctggcccagaaagtgaacaccttgggggccactaaggcagccctgctaggggagacgctccaacctgtcttctctctgtctcctggcagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctagcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 20165 - DNA, 584 bp, Homo sapiens
attgccttttccgttttcacttctcctgaatgttcaataggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagctgcggatccaccctcagcagcagccccaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccc

SEQ ID NO: 20166 - DNA, 376 bp, Homo sapiens
attgccttttccgttttcacttctcctgaatgttcaataggcagctgagcctccacccagaccgaaaaccccagagatcttcaggaggaaagctctccgcagtccgacatcccagctcctcctagttccaaagcccctggaagaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgccccttt

SEQ ID NO: 20167 - DNA, 1396 bp, Homo sapiens
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaagggg

SEQ ID NO: 20168 - DNA, 1641 bp, Homo sapiens
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaagggg

SEQ ID NO: 20169 - DNA, 906 bp, Homo sapiens
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagaggttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatcccta

SEQ ID NO: 20170 - DNA, 842 bp, Homo sapiens
cggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagaaattagccaggcgtgatggtgcacacctgtagtaccagctactcaggaggctgaggcaggagaattgcttgaacccagcatgcagaagttgcagtgacctgagactacgacactacactccagcctgggtgacagcacgagactccatctcaaaaaaaaaaataaactagcctacatctttcactgc

SEQ ID NO: 20171 - DNA, 3195 bp, Homo sapiens
aacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtattt

SEQ ID NO: 20172 - DNA, 2607 bp, Homo sapiens
agaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaatcactctttttatcttttattctattaatttttttttccttaaaatcacttttcttcttctcttttttagctgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgttt

SEQ ID NO: 20173 - DNA, 2712 bp, Homo sapiens
ctgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactagctcccctcccctctccctggaactttctctttcactccaactttcttactacatccatcttttctgtggcggggccaaaaaaggaaaccaggagtgccactatgctgacttcttattccttttcataacagtcttcaaagcacagctcatctaaagaatgcctacttcttttccaaataagcatcagatttatcgcctattatgcagtaacagtcaataaaatgtacttatgggggggaattactcaattattctatcagaacctattataaagactgtatttcccatagacgtttacagcaactatgtttaaaaaacaaaaacaaaaaaaaaacacacaaacctaagtagaatacattattttgcatgaaggaatgtcatttctgagctttttacacctaaaattaggctgaaatagctgagataattaatttggaacctatcaatttgagtggactttttctttagtagtacaccattttggttgttgtagtttcaaagtctttctgaagcagatatattgggattggagcggggtggggaaaactgtcactcctttcagaggaaaaggggaggagcatggagaaaaacaaaaattaaaggacttaaagaatggctatacagtgttgagtgttgaggatattaaacatgttatttttcaaacgtatgtaatatatattaaatttataaagcaaatttatgttgtgatcttgcctgaacaaattatattttaatgaaaaaactttctattaatagttcacgcaagagaaaacactttcaacatagtcgaaggcttcaagatctaagtgtatcagacttagggaaaaagtggcacaaccttcgatttaaaattctagtctttaaaatgagtttgtaaataattagctattacgttctattaagttgttttatattttaattttctggaagacaattttattttacaacgtgaacccaaataaagtaacttctgtatttaaaa

SEQ ID NO: 20174 - DNA, 1263 bp, Homo sapiens
ggaacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacagattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaa

SEQ ID NO: 20175 - DNA, 1456 bp, Homo sapiens
cggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaa

SEQ ID NO: 20176 - DNA, 2286 bp, Homo sapiens
aacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgcaaatatatacagagcttcataatcagcccaagaccacatagagcaaacatgaatgatatttcccaaaaggctgagattctgctttcttcatctaaacctgtcccaaaaacctatgtaccaaaacttggcaagggtgatgtaaaggataagtttgaagccatgcagagagccagggaagaaagaaatcaaaggagatctagagacgaaaaacaaagaagaaaagaacaatatattagagagagagaatggaacaggagaaagcaggagattaaagaaatgcttgcttctgatgatgaggaagatgtatcttctaaagtagaaaaggcttatgttccaaaattaacaggaactgtgaagggtagatttgctgaaatggagaaacaaagacaagaggaacaaaggaagagaacggaggaggaacgaaaacgcagaattgagcaggatatgttagaaaagaggaaaatacagcgtgaattagcaaaaagggctgaacaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactag

SEQ ID NO: 20177 - DNA, 5602 bp, Homo sapiens
gtgaactaaagagtcgccgcagacaagcaggcccccagatggagaaccagcctgtgaggtggcgggccctgccaggcctcccacgccctcctgggctccccgcagccccctggctcctccttggcgtgctgctgctgcccgggaccctgcgactggcaggaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaagaagcggatgcggggtccagggaaggaccccaccaggaagtgcccagatccaagatctgccagcagccccaagcagcatccttcagaatctgtctacacagctctgcagcgccgcgagaccgaggtctatgcctgcatcgagaatgaggatggcagctcacccaccgccaagcagagccccctctcccaggagagaccgcatagattcgaagatgatggcgaacttaacctggtctatgaaaatctctaggatgggctccaccgctcatagagcttgccctgggtcagaggaccggggcagcccctgccaccaaaggacttgatctgagttgggagtaaggcccccagggacaccccatcatttcaccctcacattcaaggcccttcctgtcttggccggccccactgcccccccattctatgccccaaccaccaaggctttcccatcttggggcctttgcccaggctgttccttctgccaggcaggcccttcctcccttggcccaaccagcaaagcgcccctcagtcttcaagggctttcctggatgccacccttgcccagagccctgctcactgcctcatgctgacagagcagcatgctctcttggcaccagcctgcacctcagccagtagggcagcctctgagctgagggaggaccctgcaggggcgcctagcagtgctgtgtggggagccgaggtatggaggagctggggagcagctatgcaaatccctacctacccagctgggccagaggcacgaggcagccaggcagggtgggagcaggggctggcgtgggaggtctgggggacagacaaggatgatggacccctcagaggcaagactaggatcagggacagatctggaggcccaggacatggctgagaggtggtcagcaggctgggggcatggagcagagagggcttgggtacaagctggagaggaaggagattctggcatgttggggtgagggcagagggacagatgaggggaggagggtgctggctaaacaggaactgaatgaatggcctgaagctccctctcccaagggttcccactcccattggcctggccctgtacgtgcactctgtcatctccttggtcaccctctgctccaggccttctccaccacaggacctcagctgtccctccttctacccaaggtggagtcccccaaagtcccttctgtctggcctatcctgtgcccaccacctgtggcttcatccagccctcctcctctatctttatctgccataggccgcagccctggccccctgtggattgaggtcccaagtggtccagctgtggggtttggtgctgggaccctcaatggcagccggaaggtccctctgaggcagaagctcaagccccatggggacagtggctccccagtgcctggccctgagccatttctgctgtttcaggtgcccacatcaccctcatttcctcctcgcagtagccctgcaccgtggccagaaacccatccacaggcaggcagtggctggggtccgggtgccccgggctgttgggctctgcttcctccctctgctcccccatgtctccctgagttctcccacctttgctcatttgtaaaatgggcaggtcaatcttcccaccccaccgtgtgggctgccccaaccccaaatgtgcccagggaggggggggaacccaaggcacaggccccgcccctgcccccaagcagcactgggctactggctcacagaagcacctttggttctgcaggtcatgcccctccctgcagggaagggaaagctggtggtagaggctgggcacagactgacgtccagaagaagtcccttggccctgctagggtggcaccagacttctctggtcccacaggacagccagtggcctcccaacttggttctgggcccccgcctgcaagcacacatggcaaggagggctttagcaggctcacataaccgagtggcaaggcccctgctcccagaggctggatttgaatgaactccgggcctgtttggggaggtgaagctgccaggtgtgcacaggggcctcccaggctcctggctccaccagccaaggaggtgggggcaagggtcagggcaatgggggacaatgccgctcagggtgcagtgagctcccctgggaaaaccgaagccagcaagaccaggagagggccacctcactgggcctgcctcccccacctcctgggcctctctgacctcagctcctagaccctggacccttggctgggactcagcattttccagtctttttcaggggtagacaggggagcctgggttaaactttaccactgtgccctggcccaggcatcaccaacacggcctccctgcagctgccctgccaccgacagaccccgattaaacccacacctggccttggcctcccctgctctataccttgcatggtttttgcctcacttggaataaaattccaactcctccctgtggcgtaggaggttcttgggggctgacccatcacccctctggtggacagagacattgccagcgtggtggtcgtctgtgcttggttcagggcaaggctgggaggcagtgggtgctgaggtcttcagtgagcaaggagagaggcagggaggaggaggaggaggaggagagcacagcatgaaaggacgggaccctaaagggctttggcccaagggagggtggggcaagaatgttctgagacttctgtgggcagcaaagaggactgagcacctgttctccagcccccaggactgagagcctgcagagacaagctggcacagggcgaggggtggcagggaacttcagggtgggaggtgcatggggcaggcgggaggaggaagaacagagaggggacagagagggtatgaatgggagctcctggggtgcaggcttgctttccactatgaatgggtggaggagggaagagaagaaaattgcttttgagacccacccaggctgggtggcctcagggcctcccttgaatccctgctccacctcccacagccttgtggacttgggcaagtcactggccacctgagcctcagtttgcagtgacagtcaagacagctcaggccaggcgtagtggcttatgcctgtaatcccagcatgttgggaggccgaggcgggtggatcacttgaggccaggagtttgagaccagcctggccaacgtggtgaaaccccgtctctactaaaaatacaaaaattagcctggtgtggtggcacgcacctgtagtcccagctactcgagaggctaaggcaggagaatctcttgaacctgggagacagaggttgcagtgagccgaagtggcaccactgcacaccagcctgggctacagagcacgctctgtccaaataaacaaacaaacaaacactactcagtgtctcagaaaggacagaaggggactccctggctcaggcagaagctcagtgggtgtgcatttccttcaagactcgtccttcagaaggaataggcttctggggcagtacagaggagtctaagtgagaggcaggcctccctgggagctgggcccaggctctctgcagccatgcctttaaggagtgcctacggggtagcacgatcagatggacaggccagggctgcccagagctgggggtgggagcaaggtaagcagagaggtgagggaaggagggtgctggcttagcaggagctgaatgaatgggcctggaggggaaaagctaagggggatggggtggcttgagtggagtaggtgaggcctaggtgaaggggagctgtggaccttccaggacggacggatgtgagcagtcctgagtggggactggagttagggtggggaagggaagccccaggcagcccctgcaggcccctgcccctgggccctaccgcagcagggcagccctgtctctgggtctcagctgatgcttccctctgcccactggcccctgacctggtgggatttcccaccatctctcccggcccagcctgccctgccctcctaggtcttcccaacctcccctctgcagaaacatctcagccacgtctggcacccccaggcatccctgcctgcctctaggaagttgaccccttcaatgggtttcagcctccaaccccacccccgcttgactcctgctctgtcagcacttgcttgagaaaatcatcctgggaaaccagcttctgggagcaggggccttgccactcggttctgcgagcctgctgaagccctccttgccacgtgtgcttgcaggcgggggcccagaactaagctaggaggccactggctgtcctgtgggaccagggaagtctggtgccaccctagcagagggcccatggacttcttctggaggtcagtctgtgcccagcctctaccaccagtccagaacttgcagtgggtgcggtaaacggtggcccctcctcagcaaacatttccaggggattctggcagcagagtttccatgggaacatgtgctggttctgcgctgaacccggtgtggctggggttcccttcacagccaatattgcaggaactgagcctggtggcctcggccagggtaggcagtgctctttggccacccagtgtcacaaacctgaactcaagttacaggcaaaacctgcttttcctttttctttctctctctctctctttttttttttgttaaagcacattctaatgtaaagtccatgctccattctaaagatgcctctgggatttcagggatggatttttatgtagttcaatagttttcttggcagacagcttatgcaggagaggtgggccgttggctcagtccagccaggctgagtggcgtcactccattccttgcaatgccaggggatgtcatttgtccacctgagggggcttccccagtctcccttccctgacctgtggtcagaatgatggcctcagccttgactgagcgcgggtcaggccagactctctgaacttggtgttggcgtgtgttttgtgtgtgtctggaggtgacatatgtgggtgacagaagcatatgttacagtgaaacattaaaactacagcaaagtg

SEQ ID NO: 20178 - DNA, 1580 bp, Homo sapiens
ctagatccggggaagggttttgcagaagtacccagaactgtgtccaaggtttcctcagatttgggctgttccgcagcggcaggtcccgggaaccaaggcaacagacatcttcctaggctcgcgagagcgcccccttgtcccacggctgctggggccccccagtagccatggctccggtgtccggctcacgcagcccggatagggaggcctcgggctcggggggaagacgtcgcagttcgtcgaagagtccgaagcccagcaaatctgcccgctccccgcggggccgccgctctcgctcgcactcttgctctcggtccggggaccggaatggactcacccatcagctgggtggcctcagccaaggctcccgaaaccagtcctaccgctcacgctcgcggtcgcgttctagagagcggccctctgcgccccggggcatccccttcgcttctgcctcctcgtcagtctattacggcagctactcgcgcccctacgggagcgacaagccttggcctagcctcctcgacaaggagagggaggagagcctgcggcagaagagattaagtgagagagagagaattggagaattgggagctcctgaagtatggggactttctccaaagaatcctgaaccagattctgatgaacatacaccagtggaggatgaagagccaaagaaaagcactacttcagcttctacttcagaagaagaaaaaaagaagaagtctagccgttcaaaagaaaggtccaagaaaaggagaaagaaaaaatcatcgaaaagaaaacataagaagtattctgaagatagcgacagtgactctgattctgaaacagactccagtgatgaagataacaaaaggagagcaaagaaagccaagaaaaaggaaaagaagaagaaacacagatcgaagaaatataagaaaaagaggtctaagaagagcagaaaagagtccagtgattcaagctctaaagaatcccaagaagagtttctggaaaatccctggaaggatcgaacaaaggctgaagaaccatcagatttaattggcccagaggctccaaaaacacttacctctcaagatgataaacctttgaactatggccatgctctgttacctggtgaaggtgcagctatggctgaatatgtaaaagctggaaaacgtatcccacgaagaggtgaaattggcttgacaagtgaagaaattgcatcatttgaatgctcaggttatgtaatgagtggtagcaggcatcgccgaatggaggctgtgcgactgcgaaaagagaaccagatctacagtgctgatgagaagagagcccttgcatcctttaaccaagaagagagacgaaagagagagaacaagattctggccagttttcgagaaatggtttacagaaagaccaaagggaaggatgacaaataaagattttctgattgtccagaagacatttttaacaacaaaaaagaaagtctgggttccacacatacatagaaaaagattattatgttctgagaaagctttacagtgctactgtgccttctatttaattctttcagtccttcaataaaaagctgcttattgatataa

SEQ ID NO: 20179 - DNA, 3269 bp, Homo sapiens
cgagccagtgctggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 20180 - DNA, 3741 bp, Homo sapiens
cagaataatgacatggttccttccatcctccaaaggtgaccaataatagtttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatatttgtatgtcttatgctgaaaaatcttgtttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatattaacttaaataggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatcagaa

SEQ ID NO: 20181 - DNA, 3351 bp, Homo sapiens
ggagcagtggcgctatagccacgaaagtgactggcagtgggctctgcggcgcagcttcatctgtcggcacctgcacagctatcccggggctgccctcgaccagctcctcgcgctctccgccgcctggaccaaccacgtcttcctgggctgcagcttccatatagaagaaagggaagggccaatgaagactcttggaagctagggaccaagtgcagtctttagatgggctttatgttacctctcatcttcaggtacagcccacgcttgatggaaaaaattctccaaatggctgaaggtattgatattggggagatgccttcatatgatctggtgctgtccaaaccttccaaaggtcaaaaacgccacctctcaacatgtgatggtcaaaatcctcctaaaaagcaagccggttccaaattccatgcgagacctcgttttgagcctgtacattttgtagctagtagttcaaaagatgaaagacaggaagatccttatggccctcaaacaaaagaggtaaatgaacaaacacattttgccagcatgccaagagacatctaccaagattatactcaagactctttcagtatacaagatgggaattctcagtattgtgattcatcaggattcattctcacaaaagaccagcctgtaacagccaacatgtattttgacagtgggaaccctgccccaagcaccacatcacagcaggcaaactctcagtcaactcctgagccttcaccatcacagacatttcccgagtctgtggtagccgagaagcagtattttattgaaaaattaacggcgacaatctggaagaacctttctaatccagaaatgacttctggatctgataaaattaattatacatatatgttaactcgttgtattcaggcgtgtaagacaaatcctgagtatatatatgctcctttaaaggaaattcctcctgccgacatccccaaaaataaaaaacttctaactgatggctatgcttgtgaagttagatgccaaaatatctacttaactacaggttatgctggcagcaagaatgggtccagggatcgagctacagagctagctgtaaaactcttgcagaaacgtattgaagttagagttgtccggcggaaattcaagcatacatttggagaggacctcgtggtgtgtcagattggcatgtcctcctatgaatttcctccagctctgaagccaccagaagacctggtggtgctgggtaaagatgcttccgggcagccaatttttaatgcttctgccaaacactggaccaattttgtcattacagaaaatgcaaatgatgcaattggtatccttaacaattctgcctcattcaacaagatgtcaattgaatacaaatatgagatgatgccaaatcgcacatggcgttgtcgagtgtttttacaagatcactgcttagctgaaggttatggaaccaagaaaacaagtaaacatgcagctgccgacgaggctttgaaaattcttcaaaaaacacagcccacttatccatctgtcaaaagttcacaatgccatacaggctcttcacccagaggatctggaaagaagaaagatataaaggatcttgtagtttatgagaattcttcaaatcccgtgtgcacgctgaacgacacagctcagtttaaccgaatgacagttgagtatgtctatgaaaggatgacaggcctccgctggaaatgcaaagtgattctagagagtgaagtaattgcagaagcagttggggtgaagaaaactgtcaaatatgaagctgctggggaagctgtgaaaaccctcaaaaagacccagccaactgtcattaacaacttgaagaaaggagctgttgaagatgtgatttcaagaaatgaaattcagggccgctcagcagaggaggcttacaaacagcaaatcaaagaagataatattggaaatcagctgctgagaaagatgggttggactggtggtggtttaggtaaatctggtgagggcatacgggagcctatctcagtgaaagagcagcataagcgggaagggcttggtctggatgtagagagggtgaataaaattgccaagagagatattgaacagatcatcagaaactacgcccgctccgagagccacacagatttgactttctctagagagctgactaatgatgaacggaagcaaatacatcagattgcccagaagtatggtcttaagagtaagtctcatggggtgggccatgataggtacctagtggtaggtagaaaaagacggaaggaagacctactagatcagctcaaacaggaaggccaagtgggccattacgagcttgttatgcctcaagcaaattgagatcttactaatttattttgtaaatgcctaatgaggcagatttttgaattaaagaaatgctacatgttccggttgcagagtatattcataagatgtctcaccttgttcatttcacatagtggtttattagatattggaacctaaagaattctgtccacttgtattagcttaatccagcagatgatattgtgcagttactgtttgtgtctttgatattgctgtgtccctcagattttagtagtttgacaagcaagaacacatatccaaatggaattttaccctgagaaattatcattttaaagggcatagcacagcaatctgcaacaatatgtaaagttgatattgactacaataaaaatccagtcttaattccagatttactgaaaatgtcagatcattttgtattaatctattttcatctttgtgtgaagccagttatagaatgtttgacaataaattgtgctgtacacgtaaatgtccttaccaactaaatgatgtaaaactttcttaaagtaattttagtgttcatttatttataacttctaccatgtgatttccagactattggaagtgatttactgtatcttgtgatatatgggttttaacaaattctagtcttcacgctgagagagcactacttgagagagcagttgaaagtttcaaaaactttggttcaatctgaagaaaggaagcttgaactgtttgttcttggtgccttgcagagagactcacagcaactctccattatagctttcacacggtttggatgtgcagcacatccaaggcaaccacagctgtggtagagcttggtaaaagactgaagatacattggtgctttgatgaaaaggtcagttggctggtccctctctcaaaaagcttattaagcctgaaaagccaactttgtaacatatttaaaactgctattttcgcttatttctggaatgtaaaaaaaaaaaatgtataaaaagaattagtgtatgcttcctgaataaaaaggagccaaagttgatc

SEQ ID NO: 20182 - DNA, 738 bp, Homo sapiens
ctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagactgagtctcactctgtcatccaggctggagtgcagtggcacgatcttgactcactgcaagctccgcctcctgggttcacgccattctcctgcctcagcctcctgagtagctgggactacaggcgccctccaccacacccggctaattttttgtatttttagtagagacagggtttcactgtgttagccagaatggtctcgatctcctgacctcgtgatccgccctcctcggcctcccaaagtgccccacaaccatttttacttactgatgtaaatactttttaggataaaatagagtataaatcaattataaa

SEQ ID NO: 20183 - DNA, 2379 bp, Homo sapiens
gggcagcacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtga

SEQ ID NO: 20184 - DNA, 550 bp, Homo sapiens
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccttagtggtggggctgggggctgcgtgtga

SEQ ID NO: 20185 - DNA, 2011 bp, Homo sapiens
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagatggagtctcaccctgtcgcccaggctagagtgtaggggcatgatctcggctcactgcaacctctgcctcccaggttcaagcgattctcctgcctcatcctcctgagtagccgggattacagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctcc

SEQ ID NO: 20186 - DNA, 1436 bp, Homo sapiens
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaag

SEQ ID NO: 20187 - DNA, 1034 bp, Homo sapiens
gcgcagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaa

SEQ ID NO: 20188 - DNA, 1044 bp, Homo sapiens
gttccccggcctctcttggtcagggtgacgcagtagcctgcaaacctcggcgcgtaggccaccgcacttatccgcagcaggaccgcccgcagccggtagggtgggctcttcccagtgcccgcccagctaccggccagcctgcggctgcgcagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaa

SEQ ID NO: 20189 - DNA, 1467 bp, Homo sapiens
gggaaaggttccccggcctctcttggtcagggtgacgcagtagcctgcaaacctcggcgcgtaggccaccgcacttatccgcagcaggaccgcccgcagccggtagggtgggctcttcccagtgcccgcccagctaccggccagcctgcggctgcgcagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaatattgcatgtttgctttacctcatatgagttatttataacctcttgaatcatcttctgtacacgtggattttatccaaggatatttttatttttgtccctcatttcccatggctctttctttgcatatgtgtgaaggagtttaaaatacatttccccccatctaatttatttacttttttccatacaggaagaaacagaatgctttttagaatattctaaaatagctttttgtgaaatatctaaaactatttttactgaagtttttagcttaagaaacagctaaacaagtctgttttaaaaatggtatctggctactagcccccaattaagtagcaaagaactgcttaagaccaaaaaaaagaaatcaaa

SEQ ID NO: 20190 - DNA, 580 bp, Homo sapiens
ggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacagg

SEQ ID NO: 20191 - DNA, 558 bp, Homo sapiens
gctaatatatattctccagaagtggttgccattgcataggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatat

SEQ ID NO: 20192 - DNA, 668 bp, Homo sapiens
aagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggc

SEQ ID NO: 20193 - DNA, 4358 bp, Homo sapiens
cgatgggagcgggggcgtcccggctcctgcagccgccagaggagggagagccgggggccgtcgcttcggagttggggctgagcagtcctcggggagagcgcgccaagaccgctgcagccgctggctgacggaaggagagttttacatggaagtggcttacagaaacttggcgctgaggtgcagggaagccagaaactctttgtgtctctaaggccgatgaggaatttggaaacacatgtgggacatacaagcgttggatatagaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcaca

SEQ ID NO: 20194 - DNA, 2073 bp, Homo sapiens
agaggagggagagccgggggccgtcgcttcggagttggggctgagcagtcctcggggagagcgcgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatcaacctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttg

SEQ ID NO: 20195 - DNA, 2360 bp, Homo sapiens
aggcgctgccgccgccgccgccgcccgcgcgccgcagcctggaggagccgccgccgccgccgcggccaagcgagcgccgtcggggcgggtgggcgggaagaagcggcgggcccgaggtgggggggagcagagagagcgcgcccaccaccttcccttcccccctcgatgggagcgggggcgtcccggctcctgcagccgccagaggagggagagccgggggccgtcgcttcggagttggggctgagcagtcctcggggagagcgcgccaagaccgctgcagccgctggctgagttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttg

SEQ ID NO: 20196 - DNA, 2472 bp, Homo sapiens
ttctcgtttttgttcttaaaacctgtagtgtaacctatttggtgtaaggagtttgaagcaagtatgatgagtttttacttttttttttttttttggcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggaggatgggtttccagatttccaggattctgtgcaaacactcttccagcaggctagagctaagagtgaagaacttgcagctcttagttcacagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatgg

SEQ ID NO: 20197 - DNA, 568 bp, Homo sapiens
gtcactcggccgcgcgtgggcgggagccggagcggcgaatgtagcaagagcggaatctcccaatgtgacagcgcggggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagt

SEQ ID NO: 20198 - DNA, 438 bp, Homo sapiens
aggaacagagaagaaaaagacctaggatctcatgactgaacttgaattcttaaaaggactgagcagggggaggaacatttaagctgatggaagtggaagtggaagttgctgtacattggcagcaaggcctccgagttagcttttgaatgcagttaactggtttctcttaactgtggaattcattgaaaagtcagactccgagtggtcgttccaggatatcttgaaaagcccaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccc

SEQ ID NO: 20199 - DNA, 545 bp, Homo sapiens
actcggccgcgcgtgggcgggagccggagcggcgaatgtagcaagagcggaatctcccaatgtgacagcgcgggttttctttttaaaagcggaaggagagttttacatggaagtggcttacagaaacttggcgctgaggtgcagggaagccagaaactctttgtgtctctaaggccgatgaggaatttggaaacacatgtgggacatacaagcgttggatatagaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattacca

SEQ ID NO: 20200 - DNA, 1661 bp, Homo sapiens
gaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgagctcactgttaatgaagcggctgctcaactctgtgtgaaggataatgccctgctgacaagaagagatgagctttttgccttggctcgacagatttctcgagaagtcacctataaatatacttacagaaccaccaagtcaaaatgtggagaaagagatgaattatccccaaagagaattaaagtggagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggagaaagacctttgaatctccgaatgcctaatttacagaacagacaaccccatcattttgtggtggatggggagctgagcagactttaccccagtgaggcaaagtcccactcatcagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattaagtactattttatatcca

SEQ ID NO: 20201 - DNA, 590 bp, Homo sapiens
acatttccttttcagcatcatgttcagccagacacagacaagcttgggaagaggatttaatgttgtttcttccaactctggaaacaattccactagaaggctcaatagttcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgca

SEQ ID NO: 20202 - DNA, 1661 bp, Homo sapiens; identical to SEQ ID NO: 20200

SEQ ID NO: 20203 - DNA, 2711 bp, Homo sapiens
ctctcccagtctctaagccgcggcgtctccgcggccgagaggccccagcgcccgcctccccggcccccgcccccacccccgcccccggctctgcccacgccctccgcccgccagcccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagga

SEQ ID NO: 20204 - DNA, 2318 bp, Homo sapiens
gggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagg

SEQ ID NO: 20205 - DNA, 2363 bp, Homo sapiens
gaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttagg

SEQ ID NO: 20206 - DNA, 1897 bp, Homo sapiens
ctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaatt

SEQ ID NO: 20207 - DNA, 2473 bp, Homo sapiens
gccggccgaggaccccgcccctgccggccgaggaccccgcccctgccggccgaggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaattt

SEQ ID NO: 20208 - DNA, 2086 bp, Homo sapiens
gcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagagttacagcgcacattaagcctaaaactgaccacgttaaaggagattggaaaaacatttttaaggatttcaaagagacagaaattaatacaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaa

SEQ ID NO: 20209 - DNA, 2024 bp, Homo sapiens
gggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctt

SEQ ID NO: 20210 - DNA, 2062 bp, Homo sapiens
gctttcccacgcacgcgtcccgttcgactctctttccgccggttgactttaagccgcgtcaccttggctgaggtcagaccgtgggaggcggctgggtagctgtttgcgtgagcagagacgcccctctcggaacctcagtgactcgccgataatcgaggacctgccaataacgcgatgagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaag

SEQ ID NO: 20211 - DNA, 1777 bp, Homo sapiens
aaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaagatataataaccctgagaaacttttggaaacaagatgtggacggtgtggcgagtgggccaattgttttacactgtgctgccgagctgtagggtttgaagctcgctatgtttgggattacacagaccatgtctggacagaagtctattctccttctcagcagcggtggctgcactgtgatgcatgtgaagatgtctgtgacaagccactcctttatgaaataggatggggcaagaagctttcctatgtcatagcattttcaaaagatgaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaatt

SEQ ID NO: 20212 - DNA, 2534 bp, Homo sapiens
ggaccccgcccctgccggtggctgcggtagctgctgcgcgctgaggcgcctgctcagtgtgggacgcggagagcgaggggcggcggcggcgcccgctggcgctcaagcatggcggcggcggcattgggcagctcctcaggctcggcgtccccggccgtggctgagctctgccagaacaccccggagacctttttggaggcctccaagctgctgctcacctatgctgacaacatcctcagaaaccctaatgatgaaaaatatagatccatccggattggaaacacagccttttctactagactcttgcctgtcagaggagctgttgaatgtttatttgaaatgggctttgaagagggagaaacacatctcatctttcctaaaaaagcttcagtggagcagctgcaaaaaattcgtgacctgattgccatagagagaagtagcagactggatggctcaaataagagccacaaagtaaagtcatctcagcaacctgcagccagtacccagcttcctacaacaccatcttcaaatcccagtgggttaaaccagcacacaaggaaccgtcaagggcagtcatcagatccaccatctgcttcaacggttgctgctgactcagccattctagaagttcttcagtccaacattcagcatgtgctggtctatgaaaatcctgctcttcaggagaaagcgttggcttgtattccggtccaagaactaaaaaggaaatcacaagaaaagttatcgagagctagaaaattggataaaggtatcaatataagtgatgaggattttcttttgctggagcttttgcactggtttaaggaagaattttttcactgggtgaataacgttttgtgcagcaaatgtggtggacagactaggtctagagatagatcattactgcccagtgatgatgagctgaagtggggtgcaaaggaagtggaagatcattactgtgatgcctgccagttcagcaatcgattcccaagatataataaccctgagaaacttttggaaacaagatgtggacggtgtggcgagtgggccaattgttttacactgtgctgccgagctgtagggtttgaagctcgctatgtttgggattacacagagttacagcgcacattaagcctaaaactgaccacgttaaaggagattggaaaaacatttttaaggatttcaaagagacagaaattaatacaggtagttgatgtcacttggcgatattcctgcaaacatgaagaggtgattgccagaagaactaaggttaaagaagcattacttcgagacactattaatgggcttaataagcagaggcaactgtttttgtcagaaaacagaaggaaagaacttctccagaggataattgtggagcttgttgaatttatatctcccaaaacccctaaacctggagaacttgggggaagaatatctgggtcagtggcttggagagtagcccgaggtgaaatgggtctacagagaaaagaaaccttgtttattccctgtgaaaatgagaagatttctaaacagctccacctttgttacaatattgtgaaagatcgttatgttcgagtttcaaataacaatcaaaccatttctggatgggagaatggcgtgtggaaaatggaatctatattcagaaaagttgaaacagactggcacatggtatatttggcccgaaaggaaggatcatcttttgcttatatttcctggaagtttgagtgtgggtcagttggcctaaaagtagatagcatttctattagaacaagtagtcaaacttttcagactggaacagtagaatggaaattgcgatctgatacagcacaagtagaactgacaggcgataacagtcttcactcctatgctgatttttctggtgccactgaagttattttggaagcagaattaagcagaggagatggtgatgtcgcttggcaacacacccagctgtttagacaaagcttaaatgaccatgaagaaaattgtttggagataattataaaattcagtgacctttgagaacctgaacattatagaaaagctggcaataatcaaggacttactgaagtagtctgttggttcagtgcatgcttagttggcagttaccaccctgtgctagcatatttcttttgctagctatccatcatgtaaccctcatgaaaattatctttatacgtggactataataaaatattgaattaaaacctttcttccatatgtgactataatttggagtaaagtcttgttgactcaatatgggattttaatctaaaactgtaagtatggttttaaaagttaaataatgatattcatgattaaatgctattcatgattatgataaaatcttgggcttatgatagtaatttgacattttctgatcagccattcatttcttcagaagtggttaaattagagtctcctaatatttttaattaatgtgaaagtacagtagctcataaattatataatgcatgaaaatttatatgattataaatattcaggcatttaagaaataaaatgaagtattttgcctt

SEQ ID NO: 20213 - DNA, 2134 bp, Homo sapiens
gcacaggacgcgccatggcggccgaagcctcggagagcgggccagcgctgcatgagctcatgcgcgaggcggagatcagcctgctcgagtgcaaggtgtgctttgagaagtttggccaccggcagcagcggcgcccgcgcaacctgtcctgcggccacgtggtctgcctggcctgcgtggccgccctggcgcacccgcgcactctggccctcgagtgcccattctgcaggcgagcttgccggggctgcgacaccagcgactgcctgccggtgctgcacctcatagagctcctgggctcagcgcttcgccagtccccggccgcccatcgcgccgcccccagcgcccccggagccctcacctgccaccacaccttcggcggctgggggaccctggtcaaccccaccggactggcgctttgtcccaagacggggcgtgtcgtggtggtgcacgacggcaggaggcgtgtcaagatttttgactcagggggaggatgcgcgcatcagtttggagagaagggggacgctgcccaagacattaggtaccctgtggatgtcaccatcaccaacgactgccatgtggttgtcactgacgccggcgatcgctccatcaaagtgtttgatttttttggccagatcaagcttgtcattggaggccaattctccttaccttggggtgtggagaccacccctcagaatgggattgtggtaactgatgcggaggcagggtccctgcacctcctggacgtcgacttcgcggaaggggtccttcggagaactgaaaggttgcaagctcatctgtgcaatccccgaggggtggcagtgtcttggctcaccggggccattgcggtcctggagcaccccctggccctggggactggggtttgcagcaccagggtgaaagtgtttagctcaagtatgcagcttgtcggccaagtggatacctttgggctgagcctctactttccctccaaaataactgcctccgctgtgacctttgatcaccagggaaatgtgattgttgcagatacatctggtccagctatcctttgcttaggaaaacctgaggagtttccagtaccgaagcccatggtcactcatggtctttcgcatcctgtggctcttaccttcaccaaggagaattctcttcttgtgctggacacagcatctcattctataaaagtctataaagttgactgggggtgatgggctggggtgggtccctggaatcagaagcactagtgctgccattaatgaattgtttaaccctggataagtcacttaaactcatctatccaggcagggataattaaaaccatctggcagacttacaaagcttgggacagttattggagattaatctaccatttattgaatgcatactctgtgcaaggaaatttgcaaatattagcttatttaatctgtactatccagtgaggtaatttcttcccccccaagatagagtcaagctctgtcacccaggctggagtgcagaagcatgatcacagctcactacagtttcaacgtcccccgctcaggtggtccttccacctcagcctcccaagtagctgggaccacaagtgtgcattaccacactcagctaatttttgtattttggcagagatggggtttcaccatgttgcccaggctggtctcaaactcctgagttcaagcaatccaccttcctcggcctcccaaagtactaggagtacaggcatagccacttgctcagccataatttttattattaatctcattgtacaagtgagaaaactgagacccagagagcttaagtgacttcctcgaggtcatagttacttactgccttagtcccaatttgaattcaattctgattccaaataagttgcgcttaaataagacaacagatgtgggaaaaatatgtgaatgtgtagtgttgctatgtgtactgtctttacaagtagctaattattttagcacaaagatgtgcaaagaaaggagactttatggagagttcaggagaaaaaggattttgtggtggccatcactttcattcaatttgcgactgctctgatggcacattagatgaagttactgttgatcctgagttacgtgaataagaaaaacaattgaactgcttattaaaaaagtaaacatgt

SEQ ID NO: 20214 - DNA, 1630 bp, Homo sapiens
gagaactcctccatccttcacctaattcttcctagttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataa

SEQ ID NO: 20215 - DNA, 1503 bp, Homo sapiens
gccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgacagaa

SEQ ID NO: 20216 - DNA, 1670 bp, Homo sapiens
tctgtgagtttttccggtgcacgcgagtgcttctgaaacgtcagctgcgctcccctaggagtgctgagcccgcggaaccgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggatttttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcagcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtg

SEQ ID NO: 20217 - DNA, 462 bp, Homo sapiens
aaagggggctgatgccccagcctcaactctgaccctggtgccaggcctggttagcatgctcttggtgcagactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtgg

SEQ ID NO: 20218 - DNA, 2936 bp, Homo sapiens
gcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacga

SEQ ID NO: 20219 - DNA, 3031 bp, Homo sapiens
agagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacga

SEQ ID NO: 20220 - DNA, 1912 bp, Homo sapiens
ttactccaattcctatgggccagagtttgctcactgcagagaaatacagtggaattcgctgggcaatggtttggcttatgaagactttagtttccccatctttcttcttgaagatgaaaatgaaaccaaagtcatcaagcagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgt

SEQ ID NO: 20221 - DNA, 2701 bp, Homo sapiens
gatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccc

SEQ ID NO: 20222 - DNA, 2745 bp, Homo sapiens
atggactttaatctcattttagaaagtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccc

SEQ ID NO: 20223 - DNA, 776 bp, Homo sapiens
agagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccag

SEQ ID NO: 20224 - DNA, 958 bp, Homo sapiens
atgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgc

SEQ ID NO: 20225 - DNA, 659 bp, Homo sapiens
cgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagagga

SEQ ID NO: 20226 - DNA, 824 bp, Homo sapiens
ggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggat

SEQ ID NO: 20227 - DNA, 448 bp, Homo sapiens
cagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccaggcagaatgtcaggctgtctgataccttcctgtgttccttcatggaattcctttcctattccagggatttaatggagaagctgaaagggag

SEQ ID NO: 20228 - DNA, 702 bp, Homo sapiens
ggcaagatggctacggcagggggtggctctggggctgacccgggaagtcggggtctccttcgccttctgtctttctgcgtcctactagcaggcctcttcctggacttcgagcctgaccctctcccactttgtccagatgtctcgtttttcccacaaccccagccacccaccccacagtcgaaaggaacaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcac

SEQ ID NO: 20229 - DNA, 1979 bp, Homo sapiens
agagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattac

SEQ ID NO: 20230 - DNA, 2616 bp, Homo sapiens
ttcttgaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagttcaagaccagcctgaccaacctggagaaaccccgtctctactaaaaatacaaaaaattagctgggcgtggtggtaggcacctgtaatcccagctacttgggaggctgaggcaggagaatctcttgaacccgggaagtggaggttgcggacctgagatcatgccattgcactccagcctgggcaagaagagcgaaactccatcttaaacaaacaaacaaaaaaaaaagaactgggacccttctgccatctgacatagcccaaagcacatctctatcctttctcccagttgcccctctccttttttgttgttttttttgaggttgagttttgctcttgttgcccaggctggagtgcaatagtgcaatcttggctaactgcaacctccgcctcccaggttcaagcaattctcctgcctcagtctcccgagtagctgggattacagtcatgcatcaccatgcctggctaattttgtatttgtagtagagatggggtttctccatgttggtcaggctggtctcaaacacctgacctcaggtgatctgcctgccttggccttccaaagtgctgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgca

SEQ ID NO: 20231 - DNA, 2040 bp, Homo sapiens
ggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagatgctgtgtgacatggctagaatatcggagctacgcctgattctgcggcagccatcaccactgtggctgtctttcacagtggaggagctgcagatctatcagcagggaccaaagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagcataagaactgggacccttctaggcagggtgcagtggctcacgcctgtaatcccagcactttgggaggcccaggcaggcggatcacctgaggtcaggagctggtctcaaacacctgacctcaggtgatctgcctgccttggccttccaaagtgctgggattacaggcatgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgcaggtggcgacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccat

SEQ ID NO: 20232 - DNA, 1625 bp, Homo sapiens
ttcttgaggctcggctgaggatgccgggaagggctggtggtcgggggcctagagcggcggttgcacttagttgcggctgctgtcaccatgtcccgcgttttggtgccttgccatgtgaaaggctccgtagccctccaggtgggcgacgtgcggacctcccaaggccggcctggcgtgctggtcatcgatgtcaccttccccagcgtcgctcccttcgagttgcaggaaatcacgtttaagaattactacacagcttttttgagcatccgtgtccgtcagtacacctcagcacacacacctgccaagtgggtgacctgcctgcgggactactgcctaatgcctgacccacacagtgaggagggagcccaggagtatgtatcgctgttcaagcatcagagcccctccgtgacctttcccaagtggctctcccacccagtgccctgtgagcaacctgcactcctccgtgagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttgaatggttgctcctagccaagatgttggcctttctgtgcccacccagacttggtttgggccaccagaggctgaagtgtatttcctgtgcattccaagtgttgcctgcatgcctgttctgtctgggccacattcacagattcaggattctcaggggcttaccgtgttacttcagcatgagctcctggcatgggggtgctctgtcttcgcctggctgcaactcaattcttccttctacccaaaaacactccagtcagttgtacttactgagaatccctgagtgccctctgccccttctggcaacatgcacattcctgtcttctgcctgctccctcatgtcagtgcagttgggctgggctgacctactaaaacctgctccatgtatggacctggaaggccattgctgccatggcacttgggacacttgaggaagaaacagaaaccttatttcttcctgtgtgtcccctagtggttttctttccatttgtgttatgccacagagagaaatttcctgtctgaactcttctgctgcctgcctaggaaggaaacctgaagatttgggcagcctgagtctcttggtttctgagctggctcctgaatatatgttcaagtgggtgtgcccatagggcctgggcacgtgtctctagcaaaaccagggcctgagccaccgcgcccgccctgcccctttccaagagatatgctcagcataatgagagatcaaccgtggtggggagtgggtccaagtaagggttctcattgttgccttttaagaggcctaagtcctgcattaactcagtccaaccattaagtgatgcaggctgctcttccctcatgtgagaaaaacctgtttccctctggttcttcctggctttgcacctggtggctattacaaagcagtactgcagtatgtcttggacctggaaagttggacatgtgtgtggctcaacagttttctcgggggagttcagtgaccttttggtggccaccctctgttctcacctgtgagttcttgca

SEQ ID NO: 20233 - DNA, 1610 bp, Homo sapiens
gccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctg

SEQ ID NO: 20234 - DNA, 1867 bp, Homo sapiens
taggcgctgtgctggggtcgcggcggcgcgggcgctgggggagaggagtgtggtcttcagcatagagtgagcttctagtgacacgagctggagggaaagaggaagtgcatcaggacggctcgtccaatggacaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtccagttgactttagtccttgtttctaactgccaagtcatgtgctgagtagaggctcagtggttggggcccaatggttcatctaggacgggactagagaggtcagtctacaagcaatccattgaccacttacttggtgctgcacacaaatgttggtgctatgggacccaaagatgagcaattagtattccagtcttcattgcctgtgcttacaaaagaagacctcacttccctaaacatctagttatggcggctcaagcccgtacctgcctacagagaagtgtctgcagttactcactattagtttcctaagggggcactgctggctccttctctcccaggaatgggcttctcctattctttaactcttgccttctccctggagaggctaccaaaccctggcctctgccgctgttcaggctgccatgtgggtatagctgtttgctagactccactctggcctcaggggccagagaacagctgtccagcatttctgttcatcccagcaatccaaaaaaaaatttttttaagctacaaagatcactccattttcaaattcagactctgccacttattagctgtttctcattaggcaagttatataaccttgcagtgcctcactttcctcatctataaaatgagattaaaatagtctttttattaagagaattaaagtgaattgtggccaggcactgtggctcatgcctgtaatcccagcgctttgggaggctgaggcagacagattgcttgagctcagaagttcgagactggc

SEQ ID NO: 20235 - DNA, 1569 bp, Homo sapiens
gggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaa

SEQ ID NO: 20236 - DNA, 1863 bp, Homo sapiens
gggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagta

SEQ ID NO: 20237 - DNA, 2037 bp, Homo sapiens
agggcccgccccagcgaaggggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatg

SEQ ID NO: 20238 - DNA, 2449 bp, Homo sapiens
agggcccgccccagcgaaggggcggggcgcagatctgtttccctcagactccatctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgagataaagaaactgaggctcagagaggctacgttaatcacggtcacacacaaataggacgtggagctcccatctgtggagctctgaagccatgcttatggccatcttcaaaacagggatctgcaggctgggaacatgatgtggctggctttacacctcccacagttgccctccaatctttcctgaagaccagtgggactgctgaggacaccaagaacatgcccccagggtcaatccacaggcccaaggtaccactcaggcaggcagcaagaagcagttaatggtcatgccccatagaggcgcagtggaagtccctggcaaatgcatgttgtattggaagtaattatttccacaacaaagttcagagatccagctaatattcaaagtagggtcaacctgaactaggaccttcaaggcatcatcacagcaaactgctcagatctccaccccagatggaaggcccagaccatggcaaggcactcttctcgacccctgcagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagtactaatg

SEQ ID NO: 20239 - DNA, 763 bp, Homo sapiens
cgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataaggggtggctggcagaggatccttacaccgacaaggaagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacaggaatgtaccaggtcatccagggtatcatctctcctgtcaacgacacctatgggaagaaagacctcgcagcttctcatcaccgagtggccatggcccggctggccctgcagacatccgactggatccgggtggacccttgggagagtgagcaggcacagtggatggagacagtgaaggtgctgaggcatcatcacagcaaactgctcagatctccaccccagatggaaggccc

SEQ ID NO: 20240 - DNA, 1711 bp, Homo sapiens
atctgcccggggccgctaagggagcgcaaggtcaagttcgccttggccccgcctccagctcaggtactaggggatctagacctgaggctgcccgggccggaggcagccttgagtcccgagaccaaacgtcgtttccctctcggacctcgggcgccgggccgcgcgctgaccgacagcccctgctaggcccagcaggtcccctagtcccccgcagtcccccgagactcgccgagcgccgttgctgagccctgcaaatagcagctacctgcttcagcctagatcctgccatgaagcggactgctgctccctggctcccactctgatctgcttttcactcttgccttgtctcccaattaataagcagggtggccactgcaacaggtgtggatgtgcctgacaagatgaagagccgaatacctgtggtgctcctggcctgtggctcctttaaccccatcaccaacatgcacctgcgcatgtttgaggtggccagagatcacctacaccaaacagctgtgcctgagctgaagcttctctgtggggcagacgtcttgaagaccttccagacccccaacctctggaaggatgcgcacatccaggaaatagtggagaagtttggcttggtgtgcgtgggccgagtaggtcacgacccaaaaggttacatcgcagaatctcccatcctacggatgcaccagcacaacattcacctggccaaggagcctgtgcagaatgagatcagtgccacatacatcaggcgagccttgggccaagggcagagcgtaaagtacctgattcccgatgctgtcatcacgtacatcaaggaccatggcctctacaccaagggcagtacctggaaaggcaaaagcacccagagcactgagggcaagacaagctagggaggggggactcagcacccacacctcctccaacaagctcctgctggggagagggctgttaaggtttctgttttactttggtttttgcttctccatttttcatttgctttatttctacagtgattctacttctgaggagtcttctgtcccaggaagagataccttctttacaggagaggaaaggtctaaatcacaaggatagacatttatcaaagaagttaaaatggtgtggcaggtcattaggattaggcagaatctctcagagctgctggacaaggaggtctacttattttgtgtggatggtaattatggcatgcacgctgaatgcagttctgagcatggcagcggcccctgagggtcagatcagaattgcccacaatgtgttttttaactaggaccaggtgcagcatgctagtcttgattggaaagatttgacaggatgctaattactgaacagtgggttttgtcaacgccctggtttcagaatatgaactgaggagtcaaacagttggaaacagcacattgctgatttacactggatcttgccttagaaaccattgtctgcctgcctaaccagcttttcataaaatttaaacaaaactctttctacgtagtgatcctcaagcaatatttttgatacagcaagtgtcaaacttgctatagcataaaagccggggctcctgatttccaggtttctaaaaaggaactgaggtaaaacagatgcctgaccgttttaaaggatcttttttaatgttttatgactgcctgtctgtttgaatactggcaaagggataaataataaattgacatcaaaaagt

SEQ ID NO: 20241 - DNA, 6483 bp, Homo sapiens
gatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaaactaaaaataatcatacttggattttatttatttttgtcatagtaaaaattttaatttatatatatttttatttagtattatcttattctttgctatttgccaatcctttgtcatcaattgtgttaaatgaattgaaaattcatgccctgttcattttattttactttattggttaggatatttaaaggatttttgtatatataatttcttaaattaatattccaaaaggttagtggacttagattataaattatggcaaaaatctaaaaacaacaaaaatgatttttatacattctatttcattattcctctttttccaataagtcatacaattggtagatatgacttattttatttttgtattattcactatatctttatgatatttaagtataaataattaaaaaaatttattgtaccttatagtctgtcaccaaaaaaaaaaaattatctgtaggtagtgaaatgctaatgttgatttgtctttaagggcttgttaactatcctttattttctcatttgtcttaaattaggagtttgtgtttaaattactcatctaagcaaaaaatgtatataaatcccattactgggtatatacccaaaggattataaatcatgctgctataaagacacatgcacacgtatgtttattgcagcactattcacaatagcaaagacttggaaccaacccaaatgtccatcaatgatagacttgattaagaaaatgtgcacatatacaccatggaatactatgcagccataaaaaaggatgagttcatgtcctttgtagggacatggataaagctggaaaccatcattctgagcaaactattgcaaggacagaaaaccaaacactgcatgttctcactcataggtgggaattgaacaatgagaacacttggacacaaggtggggaacaccacacaccagggcctgtcatggggtggggggagtggggagggatagcattaggagatatacctaatgtaaatgatgagttaatgggtgcagcacaccaacatggcacatgtatacatatgtagcaaacctgcacgttgtgcacatgtaccctagaacttaaagtataattaaaaaaaaaaagaaaacagaagctatttataaagaagttatttgctgaaataaatgtgatctttcccattaaaaaaataaagaaattttggggtaaaaaaacacaatatattgtattcttgaaaaattctaagagagtggatgtgaagtgttctcaccacaaaagtgataactaattgaggtaatgcacatattaattagaaagattttgtcattccacaatgtatatatacttaaaaatatgttatacacaataaatacatacattaaaaaataagtaaatgta

SEQ ID NO: 20242 - DNA, 4310 bp, Homo sapiens
cgaggtgggagcggagctgcagtcacgtggccgcccgccgccgcggagttggggctgttcttccgggttggaggcgcagcgccgcggggcccaagcccgggtctgccagcgcgacgtcctctcgcggccctcagggcacagcccaaggctgtcagcctcccggcccagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtcagatcacagctgctggaaaagttcctccagctaagattctgatagttggtggtggtgttgctgggcttgcttctgcaggcgcagcaaagtcgatgggtgcaattgttcgaggatttgacacaagagctgcagctttggaacagttcaagtctcttggtgctgagcccttggaggtggacttgaaggaatctggtgagggacaaggaggatatgcaaaagagatgtccaaagagttcattgaagctgaaatgaaactctttgctcaacaatgcaaggaggtagacatccttatcagcacagcacttattccaggtaaaaaagctccagttttatttaataaagaaatgattgagtcaatgaaggaaggttcagttgttgtggatttagctgctgaggctggtggaaactttgaaaccactaagccaggagaactctacattcataagggaattactcacataggctacacagacctgcccagccgaatggccactcaggccagcaccctatattccaacaacatcaccaaactcctgaaggccatcagcccggacaaagataatttttattttgatgtgaaagatgactttgactttggtacgatgggtcatgtcattagaggaactgtagtgatgaaagatggtaaagtgattttcccagctcccacaccgaaaaatattcctcaaggtgccccagtaaaacagaagacagtggctgagctggaagctgaaaaagcagctaccattacacccttcaggaagacaatgtcaacggcttctgcatatacagcaggtctcacagggatactgggtttgggcattgcggctcccaatctagccttttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggc

SEQ ID NO: 20243 - DNA, 707 bp, Homo sapiens
cccttgggtcctctctgttacagaagttctgatttttcctagcgagctggaggaaagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcg

SEQ ID NO: 20244 - DNA, 754 bp, Homo sapiens
ctctgttacagaagttctgatttttcctagcgagctggaggaaaggcagtgatttgccttcaaggaaactggggagtcagaaaattgggaactcatatcaacatggcaaacctattgaaaacagtggtgactggctgctcgtgtcctctacttagcaatttggggtcctgtaagggtctacgtgtgaagaaggattttttacgaacattttatactcaccaagaactgtggtgtaaagcgcctgtaaaaccaggaattccatataagcaactgactgttggagtccccaaagagatattccaaaatgagaagcgagtggcattgtctcctgctggtgttcagaacttggtcaagcagggttttaatgttgtcgtggaatcgggtgcgggcgaagcttccaagttctcagatgatcactatagagtggcaggtgcccaaatccaaggggcaaaggaagtgctggcttctgatttggtggtcaaagtgcgagcccctatggttaatccaacattaggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcgggttataaggctgttgtcctagcagcaaatcattttggacgtttttttactggtc

SEQ ID NO: 20245 - DNA, 2391 bp, Homo sapiens
ctttcccttgggtcctctctgttacagaagttctgatttttcctagcgagctggaggaaaggcaggtacccggagtggagttatattacctgtttctttgttctgatgggaccccagagaggacatcacgctttgtaactggttcttcaaggggagaagcaaatgtgtccctgaaaacttcagctgccgcgtttggcaccagtgatttgccttcaaggaaactggggagtcagaaaattgggaactcatatcaacatggcaaacctattgaaaacagtggtgactggctgctggtgttcagaacttggtcaagcagggttttaatgttgtcgtggaatcgggtgcgggcgaagcttccaagttctcagatggtgaccacttttggcttggctggcattgtggggtatcataccgtctggggagtgacccctgctctccactcaccactgatgtctgtgacaaatgcaatctcagggctgactgcagttggtgggttggcactgatgggaggacatttgtatccttccacaacttctcagggccttgctgctcttgctgcattcatatcctctgtcaacattgcaggtggctttctggtgactcagagaatgctggacatgttcaagcgtcccactgaccccccagaatacaactacctgtacctgctccctgccggcacctttgttggtggatatttagctgccctctacagtggttataacattgaacagatcatgtacctaggctcgggtttgtgctgtgtcggtgccttggctggcctctccacccagggaacagcacgtcttggcaatgcactgggcatgattggggttgctggaggactggcagccaccctcggagtcctaaaaccgggcccagaattactagctcagatgtctggagcgatggctttgggtggtaccattggattgacaattgccaaacgcatccagatttctgatttacctcaattagttgctgcttttcacagtttagtgggtttggcagctgtacttacttgcatagctgagtacattatagaatatccacattttgctacggatgcagcagcaaatctcaccaagattgtggcctacctcggcacttacattggtggcgtcacctttagtgggtctctcattgcctatggaaaattgcagggtctcctgaaatctgcccctctcctactgcctggaaggcacttactcaatgcaggcttactggctgctagtgtgggcgggataatcccattcatggtggacccaagctttactactggcatcacctgtctgggttcagtgtctgctctctctgctgtcatgggtgtgactttgacagctgctattgggggtgctgacatgcccgtcgttatcactgtgctgaacagctactcaggctgggccctgtgtgcagagggcttcctgctcaacaacaatctgctgaccatcgtgggtgcactcataggctcgtctggtgctatcctgtcatacatcatgtgtgtggcaatgaatcgctccctggctaatgtgattcttggaggctatggcaccacttcaacagctggtggaaaacccatggaaatttctggcacacatacggaaatcaaccttgacaatgcaattgacatgattcgagaagctaatagcattattattacaccaggctatggtctctgtgcagccaaagctcaataccccattgctgatttggtaaagatgctcactgagcaaggcaaaaaagtcaggtttggaattcacccagttgcaggccgaatgcctggtcagcttaatgtgctgctggctgaggctggtgtgccatatgacattgtgttggaaatggatgagatcaaccatgattttccagatactgatttggtccttgtaattggagctaatgacactgttaattcagcagctcaagaagatcccaactctattattgcaggcatgccagtccttgaggtctggaaatcaaagcaggtgattgttatgaagaggtctttgggtgttggctatgctgcagtggacaatccaatcttctacaaacctaacacggccatgcttctaggtgatgccaagaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggaga

SEQ ID NO: 20246 - DNA, 4582 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagtgttaaa

SEQ ID NO: 20247 - DNA, 1213 bp, Homo sapiens
gagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcaagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagaggtatgtgttttatattaaaagtttcaataaggcatttcttataattaagtttgtttatgtttgataaagaacacaatataaatacaa

SEQ ID NO: 20248 - DNA, 300 bp, Homo sapiens
gtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatg

SEQ ID NO: 20249 - DNA, 1147 bp, Homo sapiens
tagtgttgactgaggttgtctttattagaagtctcagccatgcctccagtttcgagatgaatctcaattcacaagttccactatgaatctcaattcacaagttccactaccaccaccaccatcactgcccccagatagaatgagacttctaataacttgaaagacaagtctataaatatcctgtaatcgttttcactgtatcactttttcctggctacttttatccgataaaaacctcaatttatttttaagctattaaacatgcggacaaagggaatcttagttttatgcaaaaacgcaaccacgcatgagaactgcgcaagtctttcttggaatggtctgtatttgggtgaagtcatcagacgtcattacacttctttattttggggttgccaactcgtttcccaggatttaaagactataacgatgataaaagtcagtgtcgcaccctgtcaaaggcttggcccgttgccttttccttcccggcaatactcggttcaattaggtcttgtcccctcattatctgtgaggactgaattccacccccgcttttcaacgcaggctctttgctcgggaaaagtcaaaccatctctcaaaggatcaaagagctcagccatagacagagccgccggaggaaagcggagtcgctgcatcagatgaaaggggcccctcagcctcactcctcaccgcagctcctgggatcttaaagacagggtcaggaggatcaggagggacaagagggatggaggcgaaaggctggatccttaatccaggccggagacaaagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaa

SEQ ID NO: 20250 - DNA, 1721 bp, Homo sapiens
gtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggttgggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctga

SEQ ID NO: 20251 - DNA, 1654 bp, Homo sapiens
gcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttcccca

SEQ ID NO: 20252 - DNA, 1877 bp, Homo sapiens
gcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacaggtggctgccccaccgccctcatcctgacccccagccccggtagagccctgactgggagctagccccaagcttctctttccttacctcctccctgcagctgtgtgagccgctcccatccctggcagagtctagagccttggcccagctgtccctgagccgactcagccctgagcacaggcggctgcggagccctgcacagtaccaggttggggggaggcccaccctgtcattctgccctgtgcgcccccgccctcaccctgcccaccgctcctgtcctctgctccctgcaggtggtgctgtccgagaggctgcaggccctggtgaacagtctgtgtgcggggcagtccccctgagactcggagcggggctgactggaaacaacacgaatcactcacttttccccaca

SEQ ID NO: 20253 - DNA, 1965 bp, Homo sapiens
gagacacgagcgactgggggcacctctggtgaccaagaccgggctgcgctccaaagaggccgttgggcctggagtggggttggggggtccgagaggagttgggtgacatcccccaccccatcccgggtccagctgtttcagcccctctcggcgcgccgatactattagccccacccgtcctccatcgagtcccgtgccgctcccaaacggcacgataagccccacagggagtgcgccataggccggggcgcgtcacggggtcggggcggggcggagtccggacgtcgggagcaggatggcggcggagcaggaccccgaggcgcgcgcggcggcgcggccgctgctcactgacctctaccaggccaccatggcgttgggctattggcgcgcgggccgggcgcgggacgccgccgagttcgagctcttcttccgccgctgcccgttcggcggcgccttcgccttggccgccggcttgcgcgactgtgtgcgcttcctgcgcgccttccgcctgcgggacgccgacgtgcagttcctggcctcggtgctgcccccagacacggatcctgcgttcttcgagcaccttcgggccctcgactgctccgaggtgacggtgcgagccctgcccgagggctccctcgccttccccggagtgccgctcctgcaggtgtccgggccgctcctggtggtgcagctgctggagacaccgctgctctgcctggtcagctacgccagcctggtggccaccaacgcagcgcggcttcgcttgatcgcagggccagagaagcggctgctagagatgggcctgaggcgggctcagggccccgatgggggcctgacagcctccacctacagctacctgggcggcttcgacagcagcagcaacgtgctagcgggccagctgcgaggtgtgccggtggccgggaccctggcccactccttcgtcacttccttttcaggcagcgaggtgccccctgacccgatgttggcgccagcagctggtgagggccctggggtggacctggcggccaaagcccaggtgtggctggagcaggtgtgtgcccacctggggctgggggtgcaggagccgcatccaggcgagcgggcagcctttgtggcctatgccttggcttttccccgggccttccagggcctcctggacacctacagcgtgtggaggagtggtctccccaacttcctagcagtcgccctggccctgggagagctgggctaccgggcagtgggcgtgaggctggacagtggtgacctgctacagcaggctcaggagatccgcaaggtcttccgagctgctgcagcccagttccaggtgccctggctggagtcagtcctcatcgtagtcagcaacaacattgacgaggaggcgctggcccgactggcccaggagggcagtgaggtgaatgtcattggcattggcaccagtgtggtcacctgcccccaacagccttccctgggtggcgtctataagctggtggccgtggggggccagccacgaatgaagctgaccgaggaccccgagaagcagacgttgcctgggagcaaggctgctttccggctcctgggctctgacgggtctccactcatggacatgctgcagttagcagaagagccagtgccacaggctgggcaggagctgagggtgtggcctccaggggcccaggagccctgcaccgtgaggccagcccaggtggagccactactgcggctctgcctccagcagggacagctgtgtgagccgctcccatccctggcagagtctagagccttggcccagctgtccctgagccgactcagccctgagcacaggcggctgcggagccctgcacagtaccaggtggtgctgtccgagaggctgcaggccctggtgaacagtctgtgtgcggggcagtccccctgagactcggagcggggctgactggaaacaacacgaatcactcacttttccccaca

SEQ ID NO: 20254 - DNA, 4811 bp, Homo sapiens
atggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 20255 - DNA, 3647 bp, Homo sapiens
tggaggccggggcgggacgcgttgtgcagcgggtaagcgcacggccgagcgagcatggagggggaccgggtggccgggcggccggtgctgtcgtcgttaccagtgctactgctgctgccgttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 20256 - DNA, 3543 bp, Homo sapiens
actccccaaacggagcggatcacacacagtagtatttcatggtctttcctgctgcggttttcccgggggaagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatgtaaagtggatttctcctgtagggggcagggctgcgtggctttcccagtgggagccacctcacaggccctgttgcagtgaggtggactggtgcagggaagtcctggagggtttctga

SEQ ID NO: 20257 - DNA, 4508 bp, Homo sapiens
atggagggggaccgggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactatgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgaaggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtctcagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaggattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatctatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatg

SEQ ID NO: 20258 - DNA, 4741 bp, Homo sapiens
gctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattcta

SEQ ID NO: 20259 - DNA, 3171 bp, Homo sapiens
ctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggaacggcttggctcttaacctccaccttcccttcctctcccgttcttccaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggc

SEQ ID NO: 20260 - DNA, 2790 bp, Homo sapiens
agcctgctgccgcggtcagcgcctgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatgaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactagtcagtaccaccttgtcttgtacttcagaagcagcggaggaggctctcagccaggcagtcagctcaggcctgaaatgtctc

SEQ ID NO: 20261 - DNA, 469 bp, Homo sapiens
agacggcagcggcggggacgcacccaggaagccggagaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctgtaa

SEQ ID NO: 20262 - DNA, 1035 bp, Homo sapiens
ggtccgggcgggtcaggcctctgaggggatggcatgggcggagactgcaggcttctgggcctgagagggctggagctggctttccggagccgggggcggggcgcgggcgggcctcagctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgcatgtgggc

SEQ ID NO: 20263 - DNA, 1626 bp, Homo sapiens
actggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 20264 - DNA, 967 bp, Homo sapiens
cagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttactt

SEQ ID NO: 20265 - DNA, 1680 bp, Homo sapiens
gggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 20266 - DNA, 813 bp, Homo sapiens
tgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagttggctatgctttcttattgtgcatactatgaaatgtttttcttcaaaaagtgtttataagtgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattga

SEQ ID NO: 20267 - DNA, 1679 bp, Homo sapiens
cccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagttggctatgctttcttattgtgcatactatgaaatgtttttcttcaaaaagtgtttataagtgaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctag

SEQ ID NO: 20268 - DNA, 1269 bp, Homo sapiens
gaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaa

SEQ ID NO: 20269 - DNA, 1479 bp, Homo sapiens
aagtgccacagcatccggagcgccgacgcgggaccggaagtgacgcagagaagtttccgggactgaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattctt

SEQ ID NO: 20270 - DNA, 749 bp, Homo sapiens
aagtgccacagcatccggagcgccgacgcgggaccggaagtgacgcagagaagtttccgggactgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaa

SEQ ID NO: 20271 - DNA, 719 bp, Homo sapiens
acgcagagaagtttccgggactggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctac

SEQ ID NO: 20272 - DNA, 8062 bp, Homo sapiens
acagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagggcttagctcaccttcacgcacaccgagtaattcaccgggacatcaaaggtcagaatgtgctgctgactcataatgctgaagtaaaactggttgattttggagtgagtgcccaggtgagcagaactaatggaagaaggaatagtttcattgggacaccatactggatggcacctgaggtgattgactgtgatgaggacccaagacgctcctatgattacagaagtgatgtgtggtctgtgggaattactgccattgaaatggctgaaggagcccctcctctgtgtaaccttcaacccttggaagctctcttcgttattttgcgggaatctgctcccacagtcaaatccagcggatggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaggaatacctttgatctttgaaagagaagaagctattaaggaacagtacaccgtgagaagattcagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagacaaagaagatgaatcatcagacaatgatgaagtatttcattcgattcaggctgaagtccagatagagccattgaagccatacatttcaaatcctaaaaaaattgaggttcaagagagatctccttctgtgcctaacaaccaggatcatgcacatcatgtcaagttctcttcaagcgttcctcagcggtctcttttggaacaagctcagaagcccattgacatcagacaaaggagttcgcaaaatcgtcaaaattggctggcagcatcagaatcttcttctgaggaagaaagtcctgtgactggaaggaggtctcagtcatcaccaccttattctactattgatcagaagttgctggttgacatccatgttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatcttatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggagtcaatttgctgttgggaacccgatctaatctatatctgatggacagaagtggaaaggctgacattactaaacttataaggcgaagaccattccgccagattcaagtcttagagccactcaatttgctgattaccatctcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtcctccaacatgaagaaacaacatatattgcaattgctttgaaatcatcaattcacctttatgcatgggcaccaaagtcctttgatgaaagcactgctattaaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaaca

SEQ ID NO: 20273 - DNA, 8064 bp, Homo sapiens
acagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagggcttagctcaccttcacgcacaccgagtaattcaccgggacatcaaaggtcagaatgtgctgctgactcataatgctgaagtaaaactggttgattttggagtgagtgcccaggtgagcagaactaatggaagaaggaatagtttcattgggacaccatactggatggcacctgaggtgattgactgtgatgaggacccaagacgctcctatgattacagaagtgatgtgtggtctgtgggaattactgccattgaaatggctgaaggagcccctcctctgtgtaaccttcaacccttggaagctctcttcgttattttgcgggaatctgctcccacagtcaaatccagcggatggtcccgtaagttccacaatttcatggaaaagtgtacgataaaaaatttcctgtttcgtcctacttctgcaaacatgcttcaacacccatttgttcgggatataaaaaatgaacgacatgttgttgagtcattaacaaggcatcttactggaatcattaaaaaaagacagaaaaaaaaaggaatacctttgatctttgaaagagaagaagctattaaggaacagtacaccgtgagaagattcagaggaccctcttgcactcacgagcttctgagattgccaaccagcagcagatgcagaccacttagagtcctgcatggggaaccctctcagccaaggtggctacctgatcgagaagagccacaggtccaggcacttcagcagctacagggagcagccagggtattcatgccactgcaggctctggacagtgcacctaagcctctaaaggggcaggctcaggcacctcaacgactacaaggggcagctcgggtgttcatgccactacaggctcaggtgaaggctaaagcctctaaacctctacaaatgcagattaaggcacctccacgactacggagggcagccagggtgctcatgccactacaggcacaggttagggcacctaggcttctgcaggtacagtcccaggtatccaaaaagcagcaggcccagacccagacatcagaaccacaagatttggaccaggtaccagaggaatttcagggtcaagatcaggtacccgaacaacaaaggcagggccaggcccctgaacaacagcagaggcacaaccaggtgcctgaacaagagctggagcagaaccaggcacctgaacagccagaggtacaggaacaggctgccgagcctgcacaggcagagactgaggcagaggaacctgagtcattacgagtaaatgcccaggtatttctgcccctgctatcacaagatcaccatgtgctgttgccactacatttggatactcaggtgctcattccagtagaggggcaaactgaaggatcacctcaggcacaggcttggacactagaacccccacaggcaattggctcagttcaagcactgatagagggactatcaagagacttgcttcgggcaccaaactcaaataactcaaagccacttggtccgttgcaaaccctgatggaaaatctgtcatcaaataggttttactcacaaccagaacaggcacgggagaaaaaatcaaaagtttctactctgaggcaagcactggcaaaaagactatcaccaaagaggttcagggcaaagtcatcatggagacctgaaaagcttgaactctcggatttagaagcccgcaggcaaaggcgccaacgcagatgggaagatatctttaatcagcatgaggaagaattgagacaagttgataaagacaaagaagatgaatcatcagacaatgatgaagtatttcattcgattcaggctgaagtccagatagagccattgaagccatacatttcaaatcctaaaaaaattgaggttcaagagagatctccttctgtgcctaacaaccaggatcatgcacatcatgtcaagttctcttcaagcgttcctcagcggtctcttttggaacaagctcagaagcccattgacatcagacaaaggagttcgcaaaatcgtcaaaattggctggcagcatcagaatcttcttctgaggaagaaagtcctgtgactggaaggaggtctcagtcatcaccaccttattctactattgatcagaagttgctggttgacatccatgttccagatggatttaaagtaggaaaaatatcaccccctgtatacttgacaaacgaatgggtaggctataatgcactctctgaaatcttccggaatgattggttaactccggcacctgtcattcagccacctgaagaggatggtgattatgttgaactctatgatgccagtgctgatactgatggtgatgatgatgatgagtctaatgatacttttgaagatacctatgatcatgccaatggcaatgatgacttggataaccaggttgatcaggctaatgatgtttgtaaagaccatgatgatgacaacaataagtttgttgatgatgtaaataataattattatgaggcgcctagttgtccaagggcaagctatggcagagatggaagctgcaagcaagatggttatgatggaagtcgtggaaaagaggaagcctacagaggctatggaagccatacagccaatagaagccatggaggaagtgcagccagtgaggacaatgcagccattggagatcaggaagaacatgcagccaatataggcagtgaaagaagaggcagtgagggtgatggaggtaagggagtcgttcgaaccagtgaagagagtggagcccttggactcaatggagaagaaaattgctcagagacagatggtccaggattgaagagacctgcgtctcaggactttgaatatctacaggaggagccaggtggtggaaatgaggcctcaaatgccattgactcaggtgctgcaccgtcagcacctgatcatgagagtgacaataaggacatatcagaatcatcaacacaatcagatttttctgccaatcactcatctccttccaaaggttctgggatgtctgctgatgctaactttgccagtgccatcttatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggagtcaatttgctgttgggaacccgatctaatctatatctgatggacagaagtggaaaggctgacattactaaacttataaggcgaagaccattccgccagattcaagtcttagagccactcaatttgctgattaccatctcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtcctccaacatgaagaaacaacatatattgcaattgctttgaaatcatcaattcacctttatgcatgggcaccaaagtcctttgatgaaagcactgctattaaagtatgcattgatcaatcagcagactctgaaggagactacatgtcctatcaagcctatatacgaatactggcaaaaatacaggcagctgatccagtgaaccggtttaagagaccagatgagctccttcatttgctgaagctcaaggtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaatatctgtgtttttcagatttcattttttgtaaaatcagaaattaatctaaacatattcagtgataagttcatgtgtaacgacttaatgttaaaggttaaaaaaaagatttcacaaaatatacaactttcaccatatatataagcctgcaaaattagagtagtgaaagtcatgctagtccatcacccaaatatgttatagacgccatagacaggtgatgtttggtcacctatggtaactgctacctgatgaagagcataatttctgcatatccatcctcaataccatggtaaattctggggcaatagagaagcaacagaactgccacaaagtatacctcaatataattcctctagttctgcttctaaaatctgaggacagtgctagtgggaaaataattttcaaactacctggttaaccaaaatacaaaagcagctgactatgtgtgatttcataatagcacatttcttgacacttagtgctagaaatgaagatttggattttcctaacaacttacatcaagaatgtagtgtagctcattattgagaatttaggaaagcctgaatccattaattaaggaaataaatgtgactcacatttcttttactgtgacacaataatgtgatcctaaaactggcttatccttgagtgtttacaactcaaacaactttttgaatgcagtagttttttttttttaaaaacaaacttttatgtcaaattttttttcttagaagtagtcttcattattataaatttgtacaccaaaaggccatggggaactttgtgcaagtacctcatcgctgagcaaatggagcttgctatgttttaatttcagaaaatttcctcatatacgtagtgtgtagaatcaagtcttttaataattcattttttcttcataatatttactcaaagttaagcttaaaaataagttttatcttaaaatcatatttgaagacagtaagacagtaaactattttaggaagtcaacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagaagaaattatatctatacattaccttgtagcagcagtacctggaagccccagcccgtcacagaagtgtggaggggggctcctgactagacaatttccctagcccttgtgatttgaagcatgaaagttctggcaggttatgagcagcactagggataaagtatggttttattttggtgtaatttaggtttttcaacaaagcccttgtctaaaataaaaggcattattggaaatatttgaaaactagaaaatgatggataaaagggctgataagaaaatttctgactgtcagtagaagtgagataagatcctcagaggaaacagtaagaagggataatcattaagatagtaaaacaggcaaagcagaatcacatgtgcacacacacatacacatgtaaacattggaatgcataagttttaatattttagcgctatcagtttctaaatgcattaattactaactgccctctcccaagattcatttagttcaaacagtatccgtaaactaggaataatgccacatgcattcaatgggatcttttaagtactcttcagtttgttccaagaaatgtgcctactgaaatcaaattaatttgtattcaatgtgtacttcaagactgctaattgtttcatctgaaagcctacaatgaatcattgttcaaccttgaaaaataaaattttgtaaaac

SEQ ID NO: 20274 - DNA, 832 bp, Homo sapiens
gtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggatccaactggaatattctcactagataaaaccattggccttggtacttatggcagaatctatttgggacttcatgagaagactggtgcatttacagctgttaaagtgatgaacgctcgtaagacccctttacctgaaataggaaggcgagtgagagtgaataaatatcaaaaatctgttgggtggagatacagtgatgaggaagaggatctcaggactgaactcaaccttctgaggaagtactctttccacaaaaacattgtgtccttctatggagcatttttcaagctgagtccccctggtcagcggcaccaactttggatggtgatggagttatgtgcagcaggttcggtcactgatgtagtgagaatgaccagtaatcagagtttaaaagaagattggattgcttatatctgccgagaaatccttcagccaaaagtcatatttctgggaacgggttgtagtgattccagcctaaagaaagaattgtgtctgaaacatcaaaattaa

SEQ ID NO: 20275 - DNA, 1687 bp, Homo sapiens
attacaaaagctgtaatgatacaagggaaccatgtgtgctaaagaatatctagttacttcaggaatcatctgagaagcatctgaggctgtatggatttgcagcagtccagtttttttctaaacagattttattaagacaaccttctttcctgcaatttcttttactctcttcctttatcttttttttctgattcaattgctcatgcaagtgcccagggaacgcattaaaattgcttttcgtctctggatccccattttagttataaggattgttgttgctgggacatggcctcaagcacctggcctgagtacgctgggtttgaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaattcaaacattactctttggacagtttggacagtatctgtattcagattttacaacatggagtaaagaaacctgttatgaattagattacaagcagccttcaaaagaattggcactgggataagatttttcagaaaaagaaaaacatcggcaaactgtgtgtgatttttccaaagctatataaagaaccaaaggtttagtcaagaaacaaaaatcttaaagattattataacccagactaaggttgaacaacctgcatgcccagagaaaactatggcgacaaaggggaaaaggccaccactcgttttctcactgattcatgccaattaagcctacagttaaagaccagttttgttcttttcacccatttttaagctggttttctcctgataagaagaaaggaagaaagccccagacgcttggtttttctcagaacccccaaaagatgtgcaatagctgttgttacaaaccaccaaataatacagttgtgagcctgaatacaggactgaactcctatacacgtgtactgtagaatgagtattttttaataccttaaggtaggcgtcaaattctactccccaaagcagagatagattgatttatcaaaattattatctggccaacagtgtgactatcagacagcatcaaatatttgcccaatccaagattagactacacaaaagcttccttccagtattaaacaaaaagaattaaacataactatgaaaaaactttgctaat

SEQ ID NO: 20276 - DNA, 1702 bp, Homo sapiens
agtatgccccgcgccgtctccctggccacggttccaaacagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatggagactgtaatctaatttcactagacgaatactggaaaaatgaaaaataa

SEQ ID NO: 20277 - DNA, 2914 bp, Homo sapiens
ccaaacagccgtggcccgcggtgtctggcgctcggtgggtgtggttgcccctagtttgaggcctgcccgattacccgcaagacttgggcagccccgggcgccgctccgaccacgacagggaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttt

SEQ ID NO: 20278 - DNA, 2337 bp, Homo sapiens
agtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttc

SEQ ID NO: 20279 - DNA, 2879 bp, Homo sapiens
agtatgccccgcgccgtctccctggccacggttccaaacagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttcctt

SEQ ID NO: 20280 - DNA, 1841 bp, Homo sapiens
ggatgacctaaaagtggactgggatgggggtggcagggctgagtctgtgagggtgggcgggagggaacctagtcccagagtcttctgcagcctggaccagactacttaagcactgctgggtttagactgtcctttaaaataagagccgctagaagtgaacttctcattctgtccgtccctaattctgtccttctctaaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatggagactgtaatctaatttcactagacgaatactggaaaaatgaaaaataaaggaatttctgaaataaggaaa

SEQ ID NO: 20281 - DNA, 1938 bp, Homo sapiens
atgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctag

SEQ ID NO: 20282 - DNA, 2056 bp, Homo sapiens
ccaaacagccgtggcccgcggtgtctggcgctcggtgggtgtggttgcccctagtttgaggcctgcccgattacccgcaagacttgggcagccccgggcgccgctccgaccacgacagggaaaggaaccttaatctcatctttaaaataaggagaattactgagtgacctgaaggacccttttcagctggaaagtctgaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgcaactcacagctgactttcagagcagtgttttttccaaagctggaatagcctgagactctagggcctgggtctacaaggagcatgactccctaccccaccattcagatgtggagaatgcagtgaagtaggccttggctgcttacccacatcctgaccagctgtcacctcttcatttcctgttcagccactctttaagcaatcactgagcccaatgctcagagatagctcagacctgtaggtggttgtgctttgcttgcctgtaggagccccacatgccctttacagttctgggctgtctatgacttacgatatcacctcttctttttaaatgtccaagtggaaataaagtgatttgaactttgc

SEQ ID NO: 20283 - DNA, 2858 bp, Homo sapiens
atggagaagtacgagcggatccgagtggtggggagaggtgccttcgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctactaaaaatacaaaaaaattagctgggcgtggtggcacgcgcctgtagtcccagctgctcaggaggctgaggcaggagaatggcgtaaacccctccagcctgggcgacagaaccagactccgtctcaaaaaaaaaaaaaaaacaaaaaaggctgaaggcagctgtagctccacacagaccctaccctttcccctagcccagttagaaaataagtctgggccggcggcggtggctcacacctgcataggcagtgctttggccaggaggatcccttgatcccttgtggccaggagttgggagaccagcctggggaccatagcgagaccgctgtctccaccaa

SEQ ID NO: 20284 - DNA, 2055 bp, Homo sapiens
aagaaatgagatggagaagtacgagcggatccgagtggtggggagaggtgccttcgggattgtgcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttatgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggaggcctgtgcagggacagcgagcggtcctgggcggcagggtgtgggcacccagtgggagcacaggaggtctgaggcagagggaaacctggggcaagtcctcccttcctgcatgtaggaatgtcaggagggtctttgtccttaggcccccatctgtcctgcagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctact

SEQ ID NO: 20285 - DNA, 5544 bp, Homo sapiens
gagaactgtttccgggtcggggggcaggagccaccatcgagcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctgtagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatc

SEQ ID NO: 20286 - DNA, 1545 bp, Homo sapiens
atgtcggtgctgggcgagtacgagcgacactgcgattccatcaactcggactttgggagcgagtccgggggttgcggggactcgagtccggggcctagcgccagtcaggggccgcgagccggcggcggcgccttcggggaagccacgctgtaccgccgcaccgaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggtaggggtagccttgtctctgtccacttcttcacaggtatacaacctgacttcaaagttgtatgcatctaa

SEQ ID NO: 20287 - DNA, 5653 bp, Homo sapiens
gtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctg

SEQ ID NO: 20288 - DNA, 5556 bp, Homo sapiens
gtcacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaagaggaattctgcctggagttcgtccaggatttccttatggggctgcaggtcatcaccattttcctgatgctgatgatattagaaaaactttgaaaagattgaaggcggtgtctaaacaagccaatgcaaacaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcag

SEQ ID NO: 20289 - DNA, 5377 bp, Homo sapiens
gcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggtgtggagagtctcagtgccccctttcagtctggactgtgagctgctgctggttagacagtcttggtttctctttcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcacta

SEQ ID NO: 20290 - DNA, 4430 bp, Homo sapiens
cacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaagggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctga

SEQ ID NO: 20291 - DNA, 1865 bp, Homo sapiens
ggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcaatgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaa

SEQ ID NO: 20292 - DNA, 2131 bp, Homo sapiens
cggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgta

SEQ ID NO: 20293 - DNA, 1641 bp, Homo sapiens
agtgctgctcgggggcttctccatccaggtccctggagttcctggtccctggagctccgcacttggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacatt

SEQ ID NO: 20294 - DNA, 2396 bp, Homo sapiens
cacatagctagtaagttctagctagcactgagtgctgtgcccgtgaaatttatctacataggctttcacttaacctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaagcaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattta

SEQ ID NO: 20295 - DNA, 2255 bp, Homo sapiens
cgccgccttggggtctgggcgcgcggtgccgtgggggtcagcagggcggagcggcttttccaggagaaagggccctcacgggtgagcggggcgactgggctcccccgcggtgcagttgccccgcgggcgccggccccggctcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaagcaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgattta

SEQ ID NO: 20296 - DNA, 3255 bp, Homo sapiens
attgtgcctttcctctctcagggagtgccaagaaaccatctggttcatgccagaaacttgggagtcaaccttgcccccttctctgcttgccccccataaatctgccaccacaaatcctgtcaactgttcttacatctttccttcccattttttctgaccccattgcctccactctattccatttcattattttcctgccttttctattgttggagcctcctaactggcctgtgtctctgagctggccttcctgcccctcctccactggtccatttaatctgcaatctgagtgaatgttttttctaatatgcaaatatgattatattgccttcttggttaaaatgcttcagcagcttgttacattcttctttcaatttcttgaactgaatgtaatttctttagctcttaaatatgcaatttcctcttccttgattactcttttcctcctctttgtctagccaagtttcattcatccttcaggcttcagcttaaatagcctacatttgttgaggtttatggttatctctgcatgggatgtccacgttggcagggactatgagagatttttcagattataacatctgactcagagttggtgctcagtgtctgcctgttgtatgtagtataggggaggaaaaacattttttctctgccctcttaggttcagtagctgggccctgcaaaataaactgatgaaagatagattaacaggaaaaaaggtttatgcataaatgtaaagaagtggttagaccagggggctcatatgccattttaacaaagagtgataaattatagagaagtaactagacaaaagtaggggaatgcttcttgggtaaattgtaggaaggtaaatatatggcggaagctaacataagataagggttattcagtaaagtttgttatgtggactcaagttggtgccttccccattggtaagagttgctctcctcttcctggtactggaaaggaagacacatttacaaatggatatttattacctgtacataggaaaatttatgccctgcatttatacaaaaaagggagggcaaagagcaaattggtttcagctcaaaacaattcttacatgaaagtggcatattttggggtagcatacactgatcctcttcaaaaggaataatttgcttttctcttatcatggttatgagagctactttgaattaatttttgctttttgaaagtacatttaattctcaaatgtttctgcttttgaatgcagtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaacaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagaggcttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaatt

SEQ ID NO: 20297 - DNA, 3255 bp, Homo sapiens; identical to SEQ ID NO: 20296

SEQ ID NO: 20298 - DNA, 569 bp, Homo sapiens
gtccccgccctggcgggctgcctctagaacgaggagggcggcgcgtggtcgcggcgcggagccgagtgggagcgaggggtagacgcgccccggacgcgcggccgcgcccctcacttccgccccgcggtctggaccactcgccgcaaacccgcaagtccctcgccgccttggggtctgggcgcgcggtgccgtgggggtcagcagggcggagcggcttttccaggagaaagggccctcacgggtgagcggggcgactgggctcccccgcggtgcagttgccccgcgggcgccggccccggctcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaa

SEQ ID NO: 20299 - DNA, 3722 bp, Homo sapiens
agcatgcgcagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaa

SEQ ID NO: 20300 - DNA, 2553 bp, Homo sapiens
aacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccaccaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcac

SEQ ID NO: 20301 - DNA, 3447 bp, Homo sapiens
ccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 20302 - DNA, 758 bp, Homo sapiens
gatgaggctgggacactgttcgcaggaagagtccggtgttctggccccctgatgtcaccttcacgggcctgactcacagtcctaaatatctgacagcgagatcgcttttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctag

SEQ ID NO: 20303 - DNA, 3619 bp, Homo sapiens
ggcggaaccgagctgacgggcgtgcggccgctgcgccgcaaactcgtgtgggacgcaccgctccagccgcccgcgggccagcgcaccggtcccccagcggcagccgagcccgcccgcgcgccggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 20304 - DNA, 2374 bp, Homo sapiens
ccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20305 - DNA, 3447 bp, Homo sapiens
gcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacag

SEQ ID NO: 20306 - DNA, 2745 bp, Homo sapiens
cacccaccccagcccagagaggcgacccagctccctggaggcccaggcacctcatgtctgccctcaacccagagtggagcagaccttccctggagcttctcaggagccacttcaaaaggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20307 - DNA, 799 bp, Homo sapiens
ccagcccagagaggcgacccagctccctggaggcccaggcacctcatgtctgccctcaacccagagtggagcagaccttccctggagcttctcaggagccacttcaaaagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccat

SEQ ID NO: 20308 - DNA, 726 bp, Homo sapiens
attgccacagagacaagccagccaagaagtgccaccctggacgaaggtcgggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtgg

SEQ ID NO: 20309 - DNA, 806 bp, Homo sapiens
gatgaggctgggacactgttcgcaggaagagtccggtgttctggccccctgatgtcaccttcacgggcctgactcacagtcctaaatatctgacagcgagatcgcttgtagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaac

SEQ ID NO: 20310 - DNA, 790 bp, Homo sapiens
ggcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatcca

SEQ ID NO: 20311 - DNA, 716 bp, Homo sapiens
tattttgagagagcaggtttaccccagaacagtctgtggaaggtgtggggcagggaggagagctgggccgccctgaggacacagagggagaagggtgctgggagccagcctgcaagttctggggagcctcagggtgcctttgagggcacaacttgggaggccaagctcagcggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgag

SEQ ID NO: 20312 - DNA, 732 bp, Homo sapiens
gcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccact

SEQ ID NO: 20313 - DNA, 2582 bp, Homo sapiens
ttttgtctgccccttcctgcctgtgggaaggagagaaaattaggggaggccacgggcttgaaagctttccctgcatggaggccactggatgggattctagatgctcgcctgggacccaggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20314 - DNA, 2578 bp, Homo sapiens
gcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20315 - DNA, 2573 bp, Homo sapiens
gagcgtgtcggcggccgggcgggcgggggcggcgtgtccgcgtgtcccggggtgtgcgcgtccccggcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20316 - DNA, 2580 bp, Homo sapiens
cacccaccccagcccagagaggcgacccagctccctggaggcccaggcacctcatgtctgccctcaacccagagtggagcagaccttccctggagcttctcaggagccacttcaaaagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccctgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagatttt

SEQ ID NO: 20317 - DNA, 4149 bp, Homo sapiens
gccccgcccctctcctcggggatgccgggatgtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgttttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctcttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 20318 - DNA, 587 bp, Homo sapiens
cagtcaataattttcctttggatgggagtagtgttgctacttaaatatgattgatcctctttttttgttatttatgagctgtagttgtaatcaatgaaatgtcttattaatattctcagaatatttaaatggtacatgtaactagaaggaatattgagtttttgaataaccttgaagattgaaaagacactttatttcaggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaa

SEQ ID NO: 20319 - DNA, 519 bp, Homo sapiens
gtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctggaaaaggaaactattaataagcttggacgaatatgcttcaactctagaattctgaaaaaaatcagaaaactaaaaacttctgaagctctatttgaaatctctcttcaaattgagttctaaagttcctgttgcttcagacaatggatgagcaatcacaaggaatgcaagggccacctgttcctcagttccaaccacagaaggccttacgaccggatatgggctataatacattagcc

SEQ ID NO: 20320 - DNA, 1036 bp, Homo sapiens
acactcctgacagcggcggcagcaggaggaggatcgggagtcgcgggaggatgggccgccgctaggctcgcactccggacgcgcctcgcagtgcgcaggagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagctttaaaaaaagtgcagatatttgatttaatggatgccaaagcacgtgctgattgcatcaaagaaatagatcttcttaagcaactcaaccatccaaatgtaataaaatattatgcatcattcattgaagataatgaactaaacatagttttggaactagcagatgctggcgacctatccagaatgatcaagcattttaagaagcaaaagaggctaattcctgaaagaactgtttggaagtattttgttcagctttgcagtgcattggaacacatgcattctcgaagagtcatgcatagagatataaaaccagctaatgtgttcattacagccactggggtggtaaaacttggagatcttgggcttggccggtttttcagctcaaaaaccacagctgcacattctttagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaa

SEQ ID NO: 20321 - DNA, 565 bp, Homo sapiens
gaattcataaacaactgtcctcatagtgggcttaattttctgatgaaaatatggcatttatatgctttcagcatacaatttaagatttcattttaagtccattctaattcagtgaatagtcaggggaaggtaatgtctgcttttccaaagaattgaaaggttcattacatttctcaatttgtcacaatttttattaaaatcctattacttgtttcttctttatcacttgatgaattgacgaaaatacaaattcagtaggcaaatatgatatccagtatttttgataatcttattagagtagtaagcaataaaataatgagtgacaggaacatcgccgagaccacaaagaagagttctaaagttcctgttgcttcagacaatggatgagcaatcacaaggaatgcaagggccacctgttcctcagttccaaccacagaaggccttacgaccggatatgggctataatacattagccaactttcgaatagaaaagaaaattggtcgcggacaatttagtgaagtttatagagcagcctgtctcttggatggagtaccagtagcttta

SEQ ID NO: 20322 - DNA, 5536 bp, Homo sapiens
cacacgccagcgccggtgacgcgccggccgctctcccttagtccgcattcgctccagggttttgggaccctaggttgcggagtccttaccctaccctggcctctcgagcagttgtccccataactcggaatctagagccgctgttgcgaggcaggagcacgtggcagtcaagtagcttcccagtcccgaacgccgcccgtccccaccccgccgtggccactagcaacgacctctgtgaagttggagaggcggtaacggaggcactccccctgctgcaccccgccgtttctacggggctcagaaaccagtttgtttgtttcgtcggggtagtgtcgacctgtcttacgggcgtcgcccgagacaggacggagtcaaacccgtggtatcaactgaagacgagtgtcaggatgtcattttcaaaatgcgggatggtacctctgctttattaagccccgtaggaagactgccacacctagactgatgcttattagtcatcaccgttattcctactaacgtcctgtgtcactgagttttttaaatgtctagcatatctgtaaagatgccttagaaaaagaatcatggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatgggaatcctgcaaaacctggcagctatgtatggaggcaggcccagctcttcaagaggagggaagccaagaaacaaagaggaagaggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattgaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagcagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataatcctcaaaatgttttttaatcctcaactatatgaaagcatttgaatttggcttatcagaataacaagcttcagtgggaaatacagcaattatttatttaaaaaatcagatttaagatggactttcttattgcatgaaaaagatggagaaacatgccatttttcagtgaagattctaatattttatctattttgttcattgaattccatggttaaatctcataaaatatatactttattaaatcatccaaccaaagcataggaaacattgacccagaacctgacttaatggttttgaagatttactatgcaatagggtaactttgagtttcagcaaatgtctttaggttgaaggaattacctatgtcatgaaggacctgtctgtggtttttcaatggagtctttaagcatgatcttttttctgtctagtacttgttttcattctggccagcagttctacattaaatcaccttgtcaagggctctgtttacatctatacattttgaagatgaaatttttagccttaaagtttatattctcaagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatc

SEQ ID NO: 20323 - DNA, 2754 bp, Homo sapiens
ggttccaaacagccgtggcccgcggtgtctggcgctcggtgggtgtggttgcccctagtttgaggcctgcccgattacccgcaagacttgggcagccccgggcgccgctccgaccacgacagggaaaggaactgaccaacactggatgaatttgaccatttcttaggagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgttggagaactaaatccaaatgaaactgtacaggccaatttggaagcccaactcctctccaagctggaccacccagccattgtcaagttccatgcaagttttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaatcacctattttatcttttcctta

SEQ ID NO: 20324 - DNA, 1281 bp, Homo sapiens
cgcagctggagcctgcggctgaggctcgggcgcgctcaggcccggatcctggcggcctgggcggccgcaccatggactcgggaaccgaggagtacgagctcaacggcggcctgcctccgggcacacccggctccccggacgcctcgccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttgtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggaccctggatgttgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtcttaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccacatgcca

SEQ ID NO: 20325 - DNA, 1252 bp, Homo sapiens
aatttgcttgataaacatgcaggatttctttgccagtcataaagctactagctcaaagcaggctgggtgacctcagatggctccgctgggactggaaggtcactggagccactggtgaaaatgatgctgtcactaccaactcaaaaggtcacctatcagtgtgccatgtgccacctcctggagcacacacatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagcccacgcagtctgttcccggcacccggtgcgtgtgaagggacttgagggcagcgagatggaatcagcaagagaaaacatcgaccttcaacctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattgcacggctgaacctgaatgaggtagaaaagcagtggcgactcaaccagctcaacaacgcagccaccatcttggtcttcttcactgtggtcatcaatgttttcattacagccttcggggcacataaaacagggttcctggctgccagggcctcaaggaatcctctctgaatgcagcctgggacccaggttctgggcctggaacttctgcctccttcctccgtgatctgccaggctcgtgggcactttccacagcccaggagagcttctgaaaggacagtatagctgcccttgctccctacccacagcacctgagttaaaaagtgatttttatgttattggtctaagggacttccatcttggtctgaagtcctgagctcagacgcaggtactgccagccataccttcctggtagcatctgctggacctaagtaaggcatgtctgtctaaggccaagtctgcccggcttaaggatgctggttctgactctaccccactgcttccttctgctccaggcctcaattttcccttcttgtaaaatggaatctatatctataaaggtttcttcaaatcca

SEQ ID NO: 20326 - DNA, 945 bp, Homo sapiens
gttgcaaagcagccgctcggtggccgtacaacgcttcatctctccgagcctcggtttcctcatctccagccctaaaatgacgacacgccccacaggtcttgggaggattaagtgaggggacatgagcctggaagctccgaccccaggagccagcccatcaacctgaaccattacgccaccaagaagagcgtggcggagagcatgctggacgtggccctgttcatgtccaacgccatgcggctgaaggcggtgctggagcagggaccatcctctcactactacaccaccctggtcaccctcatcagcctctctctgctcctgcaggtggtcatcggtgtcctgctcgtggtcattggtgaggagcccagcctgcagtcagaccttctgcctcggcacccgtggctggcagaaaggccccacgtgtcccctgggccaccctgcattggcacaggcagctttgcaaccacacgctgacctgcagtgagccctccgctaacagaggcccaaagaccaacttccaccccgcgagggcaggcgccctgtcctgtctcctggtatcccatggagcagaccctccgcagtacctgctgaatgactgcgccagcacctcgctaactgctaactcactcactcgctcaccgcttctccatgagcactcgtccccacgcttacaggacccagcttaagttcccaaatcctggtgggatgaagcacactagggtgccccattgtactggttggcgagggcagaggcatctcagcccgatgacgaccacctcccttgatttctgccacatgggtttctgaagggcccctctctccaaactctggtgggtgttgtgggggcagctccgtgctgtggccccgtctctgaccctttccccccactccacttccctgcagcacggctgaacctgaatgaggtagaaaagcagtggcgactca

SEQ ID NO: 20327 - DNA, 3274 bp, Homo sapiens
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggatggaggcttcggctacctgaaagatgcaatgtggtgggctggatttctcaccatggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactgtttccaggagaaaaatctttacccaaatagcaatggtggcagaacttcctggaaacagattcagtgaccaaatacccaagtttacatcagtgcctgcaggttccctggaccttccttctcattcattctttcggtgccatctctatgccgttgggaagaagatggagtctgacccactgaatgtagcacagtccaaggacttctctaagatattggtcattggaagttccttcacaccaattctcctcctgagacggaatctccgttgttgttgttgttgttgttttctagcccaaggatgacatagagctggctcccagaggcccacagagcaattggccatgcctccctatccagagctgacagggacacaaccagtgtaaaatatcctgttgcctttgtcacttcctctttggaggcagaagcaagacctcagctgaccttcttactgtgaaagccacttgatgtctcagggaaaaatttcaaccagctcattccccgagcactccagcctggcagtcagcacctcggcatccacccagtccatcccaccatcaccccttccccctctacttacatcctaaggagtcggtcactgagacataaaggcagtaatcgcagaactggaaacaaaacaataatagagccacagccaaactctggtggccaaacccagtgttgcattttgtcttactctgaaagaagaacagcaaattcactgcttcaaagtggcctggctgccaagctagaatttggcagaacgcactttactattcctcaaggagtcaaccaacctatgatctggggaggtgggaagaggatgaggagcaaagttgggatttggcagaaggcagtcccaggctctctggatactaggggctaacttttgtgttgactctggtgctcatctgggaacttaggagaaacgagctcaggggtaatttctgggttgcagccttaaaggcttggacagctgtgaatctcaatggccaactggaggtgcagacttggcatggggtgcattctagctgttgaccagattgctaccgagtcccctcctccactgatgagctgcccacactgggaagcagcatgccctgactgttccaacaccacctgctatggggagtacctttggtcccctcacatttggccagaggcatacaaaaaaccagagcagctggagagggagataattactattccttcccttcctatctcctttctagccacaagagtgtgggggttggagaagaaccattagaaagggaaattagtgggctggtgtatctggaaagagggaagacttgatcctcagccccgaggttggtgcagggcctcccctgtgtgactctacctgcactctgtgtttatatcctgtgccctaagtgggccaagcccaggtaaattcctgctggccttggaactccaaggtttggctgaccagcagactggctccctgactcttcagcctcaaatccccagtttttgatgaatgtggatttctgtctgtaattaaaagcaatgcaacaagttggctcttgagaatggcagtaaactgagggccctaagagtgtggtctgcagggtcaagaataaagattacagattatattta

SEQ ID NO: 20328 - DNA, 1600 bp, Homo sapiens
agcacggggcggtgactccagagctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggttccctgctccacctctactgctcctcccaagaagtcctgtgccagattgtcaatgacctcagccctgaggtgcccagcaatgccacctttcacagctggcaggaaagaatcaggcagaactatggcttctacatcggcctgggcctggcattcctgtctagcttcctcatcggcagcagcgtcatcctcaagaagaaaggcctcttgcgactcgtggccacgggagccactcgagctgtggctgctggagaagttgccaactttggagcctacgcatttgcacctgcaacagtcgtcacgcctctgggagcgctgagtgtcctcataagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacagggttcatcgtgtttgctgtgcttctgctggtgtcatgcctcatcctcatctttgtcattgccccacgttacgggcaaaggaatatcctcatctacatcatcatctgctctgtgatcggggccttctctgtggctgctgtcaaggggctgggcatcaccatcaagaacttcttccaggggctgccagttgtccggcacccgctcccctacatcctgtccctcatcctggcactgtccctcagcactcaggtcaacttcctcaacagagcactggacattttcaacacttccctggtgttccccatctactacgtgttcttcaccacggtggtcgttacctcgtccatcatcctcttcaaggagtggtacagcatgtctgctgtggacattgcaggcaccctctcgggctttgtcaccatcatcttgggcgtgttcatgctgcatgctttcaaagacctggacatcagctgcgccagcttgccccacatgcacaaaaacccacccccttctcccgccccggaacccactgttattagactggaagacaagaacgtccttgtggacaatatagaacttgccagcacctcatcaccagaagagaaacccaaagtatttataatccattcctgaagcttggaatatgtgagtgagaggatgagtccgatggtacagcctgccctcccaatttcaaaaccacctggttattttccagtgcaactgttaccaatgggctctcttttcttgagaagttcatttatacctcatcactg

SEQ ID NO: 20329 - DNA, 10435 bp, Homo sapiens
tccggtcggcattttgttctgagagggagagacggaacgagagagagacacacacagggctccttccccccgccctcccccccctccctccgtcggtaccgactcacccgacaccaccaagccgcagggagggacgcccccgccgacaggagaattggttcccgggcccgcggcgatgcccccccggtagctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccagtgtttgggaaatgggaagtaatgacagctggcacctgaactaagtacttttataggcaacaccattccagaaattcaggatgaatggggatatgccccatgtccccattactactcttgcggggattgctagtctcacagacctcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttccaattatcaacaaaccactatctcacatagcccctccagccggtttgtgccaccacagacaagctctgggaacagatttatgccacagcaaaatagcccagtgcctagtccatacgccccacaaagccctgcaggatacatgccatattcccatccttcaagttacacaacacatccacagatgcaacaagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcagggtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactatagtttattccttgtatgcttcaatttctttctagtgatgtcatgatgctgatatttattctttaaacctcgggtaaaggtaacctgttatttggaaaaccagcatttctcttggttaaaatgatgtccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttttatgaaattggcaaataaatgaaggtattcaatttttgaggaagaatgacattgccacaaaatacctttttgtgacacctattaaaccactatgaaaataa

SEQ ID NO: 20330 - DNA, 8729 bp, Homo sapiens
acggaacgagagagagacacacacagggctccttccccccgccctcccccccctccctccgtcggtaccgactcacccgacaccaccaagccgcagggagggacgcccccgccgacaggagaattggttcccgggcccgcggcgatgcccccccggtagctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccagtgtttgggaaatgggaagtaatgacagctggcacctgaactaagtacttttataggcaacaccattccagaaattcaggatgaatggggatatgccccatgtccccattactactcttgcggggattgctagtctcacagacctcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttccaattatcaacaaaccactatctcacatagcccctccagccggtttgtgccaccacagacaagctctgggaacagatttatgccacagcaaaatagcccagtgcctagtccatacgccccacaaagccctgcaggatacatgccatattcccatccttcaagttacacaacacatccacagatgcaacaagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgatggagattcttcaacaatgaggaatgctgcatcttttcccttgagatctccacagccagtatgctcccctgctggaagtgaaggaactcctaaaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgaggttgctaggaaaatgaagaaaaaagaaaaacagaagaaaaggaaagcatatgaaccaaaactaacacctgaagaaatgatggactcttcaacttttaagagattcacagcctcaatagagaatattttggataatttggaagatatggattttactgcgtttggtgatgatgatgaaattcctcaggaactgctcttaggaaaacatcagcttaatgaacttggcagtgaatctgctaaaataaaagcaatgggtataatggataagctttcaactgacaaaactgtgaaagtcttaaatatcttggagaagaatattcaggatgggtcaaagctttccactttgttaaatcataataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtttcatctatgggaataacaccattttttgtggaaaatgtcagtgaactacagttgtgtgccattaagttagtcactgcagtattctcaagatatgaaaaacataggcagttaattttggaagaaatttttacttcacttgcaagattaccaaccagcaagaggagtttaaggaacttcaggttaaacagtagtgatatggatggagaacctatgtatattcagatggttacagcactggttttacaacttattcagtgtgtggtacacttaccatcatcagagaaggactctaatgcagaagaagattcaaataaaaaaattgaccaggatgttgtcattactaactcttatgaaacagctatgcgaacagcccaaaacttcctctccatcttccttaaaaaatgtggtagtaagcaaggtgaagaagattacagaccactgtttgaaaattttgttcaagaccttctttcaacagtcaataagcctgaatggccagctgctgaactactccttagtttgttagggagactgttggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtttcaggaggggaagatgaaatccaacaattacaaaaagcattgcttgattacttggatgaaaacactgagactgatccttcactagtgttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagatgaactctgatactgtggactatgatgatgcttgcttgattgttcgatacttggcctccatgaggccgtttgcccagagctttgatatttatttgacacagatcctacgagttcttggtgaaaatgcaattgctgttcgaacaaaagccatgaagtgtttgtctgaggttgttgctgtagaccccagtattctagcaaggcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggatactggtatcagtgtcaggaaaagagtaataaagattctcagagacatttgtattgaacaaccaacatttccaaaaatcacagaaatgtgtgtaaaaatgattcgcagagtcaatgatgaagagggcattaagaaattagtaaatgaaacattccagaaactctggtttactccaactccacacaatgacaaagaagcaatgacaaggaaaattttaaacattaccgatgtggttgcagcatgcagagatactggatatgactggtttgagcaactgcttcaaaacttgttgaagtccgaagaggattcctcatataaacctgtgaagaaagcttgtactcaacttgttgataacctagttgagcacattcttaaatatgaggaatctctagctgactctgacaataaaggtgtgaattctggaagattggtagcttgcataaccactttgttcttattcagcaaaataagaccccagctcatggttaaacatgcaatgactatgcaaccataccttaccactaaatgtagtacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtagtgcaacattgtgtgagctgtcttggagctgttgtaaataaagtgacacaaaattttaaatttgtgtgggcttgtttcaatagatactatggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggttaacataaaagataaagtacttgaactattgatgtattttacaaaacactcagatgaagaagtacaaacaaaagctatcattggtctaggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcagtgtgtgccatatttaattgctatgggcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgatagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagattt

SEQ ID NO: 20331 - DNA, 2237 bp, Homo sapiens
ccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgcctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatttatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaa

SEQ ID NO: 20332 - DNA, 12158 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttcccactccaagtcaagctttatgcaggaatgcttttccatcagggaataaatacttagaagcgcttacaaggtgccaggcacctcctttctgcatgtgcctgcctttctagtagcagacagatggaaacattgtctcattttgtcaaggagtccaaagaaatgattataaaaccaggattcatccttcttctccagaaagatttttttttaagtaaacacctttcaatccccaacacaagctgcttcacaactccaggctagaaggcaggagagcgatctgatgtgtttctttcatttgccagaattcctgataccaaaagcctctctctctgttgagtaacctctcaaggaccagagtggagtccagattgttaggctcagatcaagggtggggaaatactgccctctcgtggtggcttttcatccaggcctcgtagccaaccgtttaagtgcaaaatagaattaagcaatgggtaagcaaaatagggttgacaagatatttgggggttattcgggttatggcccatttatttccctcttccccctgaattgaccagtagcagctccagccccatttcacaaaagtgagtttggccaggaggaatgagacgtctcctgaaataggaacaccggaacatcatgctcacctgccatcactatgcatccagttcccacagcttgtgtcgtgaaagagcagagagatgatgttaaactccttgggaggagagagggcttcttttggtttccctggagtgagacagccaggtgtctttcttttgcggggggacacttcagacccatcaatatggaattttgggagccgacctgagtgcaaatcctaattctgcccctgttggtgcagatggctgtgggcggctcacttgaccttttagagtctgcatacccacctgtataacaaggtggattgaatgagacaatgcccacgaaatgcccagttacagtacctggttcaaaacttactgcattttaatttttcacttaacttataacatgtcttgcttctccagtgtgtggaaggcaccgggcagtttgcagagataagcaaaacacagttcctctcgtgcagaaggttagaatctatttttttttttgacagagtcttgctctgtcacccaggctggcgtacagtggtacgatctcagctcactgcatcctctgcctcccccagttcaagtgattcttctgcctcggcctcctgagtaactgggactacaggcgcctaccaccacgcccagctaagttttgtatttttagtagagtcagggtttcaccatgttggccaggctggtcttgaattcctgacctcaaatgatccacgcacctcagcctcccaaagtgctggattacaggcatgagccaccacgcccagccaaaggttataatctgatggagagagacacccgtcttggaactgacataaatttctggggtttgagaaatgggcgggatttcactggtagcttctggaaggtaagagttgtccaggaattgggaagagtgagaggaaaggcacggacagggagcatgtaagataaattgaggctggctttggaaggctgaggagggtgagaaaaggtgggctgggaccagaccgtggggagaggtgagtggcattacaagaaatttaggctttattcagaaggcaacagggagtccctaagaatgtttttcaaaaagggacattaaggcgattggagttatacttggaaaagaaagttctggccacagtacagagcatggcccgttgagctgttgggggggttattgctgcaaccaaggcttgagtgagggaagaggcggatgtagtgataaagagactccaggaactgaatcagcgtacctggcaccccatccattgtagagggtgagaataaaggagaaattaaagcatcttgcaggctgggcgcggtagctcatgtctgtaatcccagcactttgggaggccgaggtgggtgtatcagttgaggtcaggagttggagaccagtcagccagttagtagaaaccctgactctactaagaaaatacaaaaattagctgggcatggtggcatgcgcctgtagtctcagctacctgggaggctgaggaaggaggatcgcttgagcccaggaggtggaggctgcagtgagccaagattgtaccactgcactccagcctgggtgacagagcaagactcttatctcaaaaaaaataaaataaaataaaataaaataaaacatcttgcccctagctgagagagaggtctctgaagagcaggctcagggaaaagatgagttttcagagctgatgtgatagtcagcttctctggagtcaacagggtgaatccttcccaagtccagccatgcccagatgcccggagggaaaactgacccccagccagtagacattggctaagaacacagaatcttctgaccaaacacgctttcagcagctgcctgctctggactttgaaagaggtcaggtcttgccctaagctcaaaacaagtgagaggtgtcctgacctagctcatagggcaaatggtcctaataggatgggcaatccagatgcctgagccccttcactccgacagcaccagcgcctaatgcagccttttcattcttgccattaggaaatctgtggacttctagcctgtgttttaaaccagccatgtttccttgtatatttccctacccgctgccccacatacccagcatgccgctgtggccaccatgtcctcaaagccttctgtctgtatcaggaatgtagtctgagactgccaggaagcaacaaggagagagaaacactaactagtcttcctttataacccattcatactctctggctgtccccaaccttcatagtctcctgcatccaaatgtcctctttggctcaaaaagtaggccaggcatggtggttcatgcctgtaatagcactttgggagactgaggtgggaggatcacttggggccaggagtttgagaccagcttgggcaacacagcgcaatctcgtctctactaaaaaaaaaaaaaaaaaaaaattagctgggcatgatggcatgctcctgtggtcccagctacttgggaggctgaggcaggaggatcacttggtcccaggagtttgaggcgacagtgagctaggatcgcaccactgcactccagcctgagtgacagagcaagaccctgtctctaaaaaaaattaaaatgaaagaccaggtgctgggattaaggaaacacaggtctgagggtctgagggaaggggcctgcctcccagggagtcaacatagatgttccccatgaacagggatttgactttggaggccaacctggcctggcctctgccctttatctcacactccctatccttggcccactgccagtccctgccttgtggcaaaggggccccaaaagaaaagctgcccttccccaaatgtaaggacccaggtacactttcacccgtggaaagcagtgtctgtcgagagtctgtttcctattaatacttatcaaagccatgtgcgagggaggtggtcagctgtcaatatgccttagtatgtttatatgagtttgttttgttctaaaatacccaaacagttctggtcaagcggggctatgcccgtctggcccaaaacacagtccgttattaacgagatggccctggcaggcgggaacaaatctgcctccatgcactgcttcctgtagtcttttagaaagtaactccaggacatcgaagtgcccagatttgactcctaagttctaggagactgtagcgcagggtctgtcaaccttagcactattggcatttggggctgggtaattctttcttgtgggggccgtcttgggtactgtaggaagctgagcagcattcctggcctccatccacaagatacctgtagcagtgtcctgccaacggtaacaatcaagtatgtcatcagacattgcccaatgtccccagggggcaacacccctctcttggacttcagggtcaagagaatctctgctggctaccccaggacttctcattatagatttcctggagcacgcagcagaaactttgcctagcccagtggttgtttccattatctgctgccaaagtgggatttgagggtgtccgggggagggggcatggggagggcagtatgctttcaaaaacccctcccaggccaggcgtggtggctcatgcctgtaatcacaggactttgggaggccgaggctggcagatcacttgaggctgggagttagagaccaacctggctaacatggcaaaacctcgtctctactaaaaatacaaaaatcagcccggcgtggtggcgggcatctgtaatcccatctactcgggaggctgaggcaggagaattacttgaacccaggaggcagaggctgcagtgagccgagatggcaccactgcactccagcttgttgacagaatgagaccctgtggaaaaaaaaaaaaaagccctcccatgccagaacagaggatggcagtctgtttcaataagacactgtgtccttggtgttggttctgattaagactcactgagatccagtgctcttgagctgggtctcagtcccctcccatgtcctgtgctctgccgccactgttttcattgttgtgttctcgttgtgattgttaagactcacactcctggctcagcagtggttttccagaaggcccaaagagcggtgccgggcaccccacgtcgcagtgtccgttccgggcttgggaagctggggaggtgggcagacctggtcgcatctcaccacacacacacacacacacacacacacacacgctgtcagaaactcggccgtcccccctacctctgagctctcaatgctgctaatctctgccaagtgtccctgtgctccagcaccttccttgaaggactgacgcccaccccacgctctttgcgaggttgtccaggctgtgtttgtcgcatgctcttcttctgtatagttctcatcttccaattttatgggattcaacaaaagcctattatgcttgtttgcattatggttacaatattaaaaagtggattcaa

SEQ ID NO: 20333 - DNA, 4462 bp, Homo sapiens
ttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagaca

SEQ ID NO: 20334 - DNA, 7182 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagatgaggaaactgagaatcacagagggttttggtgctcaacgagggtcacataaccaccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaggttttcagctcctaactggaccctcttgcccagccggctgcaagttttgtaagcgcggacagacactgctgaacctttcctctgggaccccctgtggccctcgctctgcctcctgtccttgtcgctgtgccctggtttccctcctcgggcttctcgcccctcagtggtttcctcggccctcctgggtttactccttgagttttcctgctgcgatgcaatgcttttctaatctgcagtggctcttacaaaactctgttcccactccctctcttgccgacaagggcaactcacgggtgcatgaaaccactggaacatggccgtcgctgtgggggtttttttctctggggttcccctggaaaggctgcaggaactaggcacaagctctctgagccagtccctcagccactgaagtccccctttctccttttttatgatgacattttggttgtgcgtgcctgtgtgtgtgtgtgtgtgtgtgtgtgtgtgtgtgatgggccaggtctctgtccgtcctcttccctgcacaagtgtgtcgatcttagattgccactgctttcattgaagaccctcaatgccaagaaacgtgtccctggcccatattaatccctcgtgtgtccataattagggtccacgcccatgtacctgaaacatttggaagccccataattgttctagttagaaagggttcagggcatggggagaggagtgggaaattgattaaaggggctgtctcccaatgaaagaggcattcccagaatttgctgcatttagattttgataccagtgagcagagccctcatgtgacatgaacccatccaatggattgtgcaaatcccctccccaaacccacccataccagctagaatcacttgactttgccacatccattgactgaccccctcctccagcaatagcatccaaggggcctggaagttatgttgttcaaagaagcctggtggcaataaggatcttcccactttgccactggatgactttggatgggtcacttgtcctcagtttttcctagtcataatgtcatacgaacctaaagaatatgaatggattaaatgttaaagctttggtgcctggaaacaatatcaagtaacaatatgattattatttttttattcccccaaagcgggcttgctgcttcacccttggggatgaaataatggaagctggttaaagtggatgaggttggaaagagttgccataatgaggtcccacgtggcttcttcgataggagccacaacttggggtgggaagaacttgtccctcaggcttgttgccctctgcagttgatctccaaagttttaaacctgttaaattaattttgacaaataagttaccctcaactcagatcaaaaatgggcagccaagtcttcggtaggaattggagccggtgtaattcctccctaagaggcaacctgttgaatttactctctcagagtaaatggtgggaagggatccctttgtatacttttttaaatactacaaattagtgtcaggcagttcccagaaagagacaagaaatcctagtggcctcccagactgcagggtccccaaggatggaaagggaatgttctgctggttctaccctgtttgttgtgtcttgctatacagaaaaaccacatttcttttatatactgtacgtgggcatatcttgttgttcagtttgggtgtctgctaaagaggaagtgcactggccctctttgaaagggctttacagtgggggcaccaagaccccaaagggcccaggccaggagactgttaaagtgaaaaggcaatctatgactcaccttgctctgccatccctggcagcccccaccggtgtcctgttcctgccacatggagcttgacttcatgccagctataatctcccctgccttcctttaatcccaatttcccctgctcactcttccacagatataaagaacaaacacttagcatcccacactcaccccttctaatcctgaagggaagcccattctaaactcctttcctgcaaacccatttccagctcctagtagctttcctcccaaaggctttctttccaatcctttatagctttggagacgcctccccaattccccagggaaggaaactgttgtgtccaatccccattaaagacaaattgatcagtgcttccc

SEQ ID NO: 20335 - DNA, 4676 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccagacatgtaccctgatgaagtgcacctcactgtggccatcgtttcctaccgcactcgagatggagaaggaccaattcaccacggcgtatgctcctcctggctcaaccggatacaggctgacgaactggtcccctgtttcgtgagaggagcacccagcttccacctgccccggaacccccaagtcccctgcatcctcgttggaccaggcaccggcattgcccctttccgaagcttctggcaacagcggcaatttgatatccaacacaaaggaatgaacccctgccccatggtcctggtcttcgggtgccggcaatccaagatagatcatatctacagggaagagaccctgcaggccaagaacaagggggtcttcagagagctgtacacggcttactcccgggagccagacaaaccaaagaagtacgtgcaggacatcctgcaggagcagctggcggagtctgtgtaccgagccctgaaggagcaagggggccacatatacgtctgtggggacgtcaccatggctgctgatgtcctcaaagccatccagcgcatcatgacccagcaggggaagctctcggcagaggacgccggcgtattcatcagccggatgagggatgacaaccgataccatgaggatatttttggagtcaccctgcgaacgtacgaagtgaccaaccgccttagatctgagtccattgccttcattgaagagagcaaaaaagacaccgatgaccaggtattcaaaacc

SEQ ID NO: 20336 - DNA, 4307 bp, Homo sapiens
agagcggctcttttaatgagggttgcgacgtctccctccccacacccataaaccagtcgggttggacgtcactgctaattcgtttcagtgatgataggataaaggagggacattaagaaataaattccccctcacgaccctcgctgagctcacggctcagtccctacatatttatgccgcgtttccagccgctgggtgaggagctacttagcgccgcggctcctccgaggggcggccgggcagcgagcagcggccgagcggacgggctcatgatgcctcagatctgatccgcatctaacaggctggcaatgaagatacccagagaatagttcacatctatcatgcgtcacttctagacacagccatcagacgcatctcctcccctttctgcctgaccttagggacacgtcccaccgcctctcttgacgtctgcctggtcaaccatcacttccttagagaataaggagagaggcggatgcaggaaatcatgccaccgacgggccaccagccatgagtgggtgacgctgagctgacgtcaaagacagagagggctgaagccttgtcagcacctgtcaccccggctcctgctctccgtgtagcctgaagcctggatcctcctggtgaaatcatcttggcctgatagcattgtgaggtcttcagacaggacccctcggaagctagttaccatggaggatcacatgttcggtgttcagcaaatccagcccaatgtcatttctgttcgtctcttcaagcgcaaagttgggggcctgggatttctggtgaaggagcgggtcagtaagccgcccgtgatcatctctgacctgattcgtgggggcgccgcagagcagagtggcctcatccaggccggagacatcattcttgcggtcaacggccggcccttggtggacctgagctatgacagcgccctggaggtactcagaggcattgcctctgagacccacgtggtcctcattctgaggggccctgaaggtttcaccacgcacctggagaccacctttacaggtgatgggacccccaagaccatccgggtgacacagcccctgggtccccccaccaaagccgtggatctgtcccaccagccaccggccggcaaagaacagcccctggcagtggatggggcctcgggtcccgggaatgggcctcagcatgcctacgatgatgggcaggaggctggctcactcccccatgccaacggcctggcccccaggcccccaggccaggaccccgcgaagaaagcaaccagagtcagcctccaaggcagaggggagaacaatgaactgctcaaggagatagagcctgtgctgagccttctcaccagtgggagcagaggggtcaagggaggggcacctgccaaggcagagatgaaagatatgggaatccaggtggacagagatttggacggcaagtcacacaaacctctgcccctcggcgtggagaacgaccgagtcttcaatgacctatgggggaagggcaatgtgcctgtcgtcctcaacaacccatattcagagaaggagcagccccccacctcaggaaaacagtcccccacaaagaatggcagcccctccaagtgtccacgcttcctcaaggtcaagaactgggagactgaggtggttctcactgacaccctccaccttaagagcacattggaaacgggatgcactgagtacatctgcatgggctccatcatgcatccttctcagcatgcaaggaggcctgaagacgtccgcacaaaaggacagctcttccctctcgccaaagagtttattgatcaatactattcatcaattaaaagatttggctccaaagcccacatggaaaggctggaagaggtgaacaaagagatcgacaccactagcacttaccagctcaaggacacagagctcatctatggggccaagcacgcctggcggaatgcctcgcgctgtgtgggcaggatccagtggtccaagctgcaggtattcgatgcccgtgactgcaccacggcccacgggatgttcaactacatctgtaaccatgtcaagtatgccaccaacaaagggaacctcaggtctgccatcaccatattcccccagaggacagacggcaagcacgacttccgagtctggaactcccagctcatccgctacgctggctacaagcagcctgacggctccaccctgggggacccagccaatgtgcagttcacagagatatgcatacagcagggctggaaaccgcctagaggccgcttcgatgtcctgccgctcctgcttcaggccaacggcaatgaccctgagctcttccagattcctccagagctggtgttggaagttcccatcaggcaccccaagtttgagtggttcaaggacctggggctgaagtggtacggcctccccgccgtgtccaacatgctcctagagattggcggcctggagttcagcgcctgtcccttcagtggctggtacatgggcacagagattggtgtccgcgactactgtgacaactcccgctacaatatcctggaggaagtggccaagaagatgaacttagacatgaggaagacgtcctccctgtggaaggaccaggcgctggtggagatcaatatcgcggttctctatagcttccagagtgacaaagtgaccattgttgaccatcactccgccaccgagtccttcattaagcacatggagaatgagtaccgctgccgggggggctgccctgccgactgggtgtggatcgtgccccccatgtccggaagcatcacccctgtgttccaccaggagatgctcaactaccggctcaccccctccttcgaataccagcctgatccctggaacacgcatgtctggaaaggcaccaacgggacccccacaaagcggcgagccattggcttcaagaagctagcagaagctgtcaagttctcggccaagctgatggggcaggctatggccaagagggtgaaagcgaccatcctctatgccacagagacaggcaaatcgcaagcttatgccaagaccttgtgtgagatcttcaaacacgcctttgatgccaaggtgatgtccatggaagaatatgacattgtgcacctggaacatgaaactctggtccttgtggtcaccagcacctttggcaatggagatccccctgagaatggggagaaattcggctgtgctttgatggaaatgaggcaccccaactctgtgcaggaagaaaggaagagctacaaggtccgattcaacagcgtctcctcctactctgactcccaaaaatcatcaggcgatgggcccgacctcagagacaactttgagagtgctggacccctggccaatgtgaggttctcagtttttggcctcggctcacgagcataccctcacttttgcgccttcggacacgctgtggacaccctcctggaagaactgggaggggagaggatcctgaagatgagggaaggggatgagctctgtgggcaggaagaggctttcaggacctgggccaagaaggtcttcaaggcagcctgtgatgtcttctgtgtgggagatgatgtcaacattgaaaaggccaacaattccctcatcagcaatgatcgcagctggaagagaaacaagttccgcctcacctttgtggccgaagctccagaactcacacaaggtctatccaatgtccacaaaaagcgagtctcagctgcccggctccttagccgtcaaaacctccagagccctaaatccagtcggtcaactatcttcgtgcgtctccacaccaacgggagccaggagctgcagtaccagcctggggaccacctgggtgtcttccctggcaaccacgaggacctcgtgaatgccctgatcgagcggctggaggacgcgccgcctgtcaaccagatggtgaaagtggaactgctggaggagcggaacacggctttaggtgtcatcagtaactggacagacgagctccgcctcccgccctgcaccatcttccaggccttcaagtactacctggacatcaccacgccaccaacgcctctgcagctgcagcagtttgcctccctagctaccagcgagaaggagaagcagcgtctgctggtcctcagcaagggtttgcaggagtacgaggaatggaaatggggcaagaaccccaccatcgtggaggtgctggaggagttcccatctatccagatgccggccaccctgctcctgacccagctgtccctgctgcagccccgctactattccatcagctcctccccacacacacacacgctgtcagaaactcggccgtcccccctacctctgagctctcaatgctgctaa

SEQ ID NO: 20337 - DNA, 201 bp, Homo sapiens
caccccaactctgtgcaggaagaaaggaagtacccggaacccttgcgtttctttccccgtaaagggcctcccctccccaatggtgacacagaagtccacggtctggctgcagcccgtgacagccagcacaggagctacaaggtccgattcaacagcgtctcctcctactctgactcccaaaaatcatcaggcgatgggccc

SEQ ID NO: 20338 - DNA, 4931 bp, Homo sapiens
cgtcgccttttcttcttcgtcccgggcggtgcgttccactgctctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaagaaaaaagagaaagaaaaaaaagaatgaatgcaagctgatagctgagactgtgagactgtttttgtccactcttctgaatcactgccacttgggtcagggaccacagccattgccacccttggcccatctctctgcgtgcgtgccttgagcacacatataaaaagtgccatgtgcaattgtcttatcttttatgatctaggctttgcctagggatcactactccttaacgggctggctggggcaatgaggaaaagctcctttgctcctgtaaggccataagtggctgttaacagattttcaaatgcctgaagagattgctgagacctgctagagtcatatgttcggggaattaagtctttatcctagacaacaaggtacagatgcaaactgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcaggtggtgtgtgtgtgtgtgttttgtgtgtgtgtgtacacatgtgtttatatatacatgtgtgagggaaagtgtgtacatatatgtaggattgtaaccagacggaaaagaacgaggatctccagggtgtttgaatcagcaacagatttgtgttttctaacatgcatttagttggagaggcatggttctgtttgttttgttttgatctaatttgccattggaaataggtacagttacacagagaaggaagaaccaggaaagtgagatccatgaaactaaatgagcagctgtcagaatccagtgtggctgagcctacctagcttatgaaatctaacccagggttccctgagtccaagaccacttagattattaagattttgaacgtccagaggagtgaaaagtctgttttctgacgtaagccggagctgaggataaagccagaggccagtggattaggtgtatggaatgtggatggagagggcttgtgtgggatgtggccagggagtgggtgaggaaggccgcttctaaatggcctgtaaaaacttgagattggatagacgaaaggaaatggagaaattaaagaattggagaaactagttatctgtgttgctgactttgggacccatccaagactcctgcccttggggtgttccatggtggtttcttcctgcctgggcgccaccctttccccagttcaggccctccctggaggactagtttgtgtattggtatcctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgccctatatggaggacaaatggacaccaggggtgctaaccttattggtgcctgccccagcctaccccaggtgccagcagactctcgtgcacaggaggctcccacagttatggagccaggaaagaatttctctgcactggatggactgtatattgagattaaaaattatattccttatattcctgcttatatcaatgctctctctgtaaaacctcttcctagcctcatttctctcaactgatcttgtttaggcgttgtattccttttatttactctttgcttgactgcttcctcctaaccctctacccactagcactctacttcctaaagctgttgtgtcattaactctgttggatcaactctctgggaaaagattctgttaatgtaagtgcacttactccctggatgttgtcactagtctagtggcttttgctaaataaacctttcttatttcta

SEQ ID NO: 20339 - DNA, 5559 bp, Homo sapiens
ctatgaccaaatgtatggggctttttcccacacaccaagcaagcaagcagttctgcagagggcacacagtgtcctctaactcagtttgattctgatactatctacctggaaacagcatcagatcccacagtttgagggctcaatcccacaagactttcccccatttcagacaccaatcacaagtaatagtttgtcacctacacctctgaccaagtggctataaattggtgttcccactaccctctccttggactcaactgatttgctagagcaactgacagaactcaggaaaacacctacatttactggtttattttaaaggatattataagggataccaatgaacaccagatggaagagatgcatagggcagggtctgtgggaagggtggcagagctcccatgccctcccaacgtgcaccaccctccaggaacctctaaatgttcagctgcccggcagctccccacacccagtccttttgagtttttaatggaggctttattatgtaggcatgattgattacatcattggccactggtgattagtttaacttttagcccctcatctcctggaggttggggcgtgggactgaaaaatcctatcctctaatcataccttggtctgtcctgtgagcagcccccatcccgaagcttccaggggttccccaaccactaatcatctaataagcatacaaaaaacactcttaccactctggagatctcaagggtttggggagctatatgtcaggaaacagggatgaagaccaaacatgtatttcactgtatcacacctgttctcacccctccccagatcttctctcaattaatatgagacaaaaaaatgagtctgacttcttgaccaaaatatcagttctgtccttagcagctttatggaggacagatttagtttaaattccttaggcattatgcccctgtggctccactcaatcagaaatagggtcaacggcaaggtcagggcctccaatctgggcaagagggaggcagccacggtatccacaagtgtaattctctgagtgctggttgctgggaggggcacaccctgggccagcaagtcacttggccaagggtggccaactgtgaggtagcactgccctttactccctaaaaaaatgtgaatctctttggagcaaactcctcttcagaaatttgagcacttgttttctgagcaagggaatcagctaatgcttttgactccccatccatcttcctgcatcctcgtcccacctctcctgcccccactcacctggctctgtctttacccacaccatggttttggtacaagaacacccttttccccataagctacattggtccaggccataaaaattcattagttccctttcttcaggggccttctgaaatgctccctggagaactctttattcacttctttgcacaagaatcacatatgtgtgaacactggtattggccttctaactcagtttcttcaaaccagggtcctggtctggttgcccctgtctcctcccactgagttttatctccacataagtattgctcaccaagaacagagctgttgacaccactgggcctcaagcatgctgaatgcattgctgccaactgctctgccttaagaaggttggaaactgatgagggtgccacaaattgttcacctcagcccttctgggctggttggaggaggccctctcatgaatcagtcagcaaatgtttgacccctaccaggtggtcctggtaatatgtggtatgaatcatggtcctagatgtctgccatagcaaataaaaaaggaagacagggaaagaagctgtcgcctacagagtggcttgatgacagctgcctcactaatttaaaaagccatgtgtagtgcttcctatttctcactatgtttgggtgagtgggagagggagaaagattatatgggcttcgttgtgacactgttcttagccagtgggtcaatagatgagttttggttttgttttttagaagacaggatgagaagagagtgcccccttccacctccaacatggcatgccatgctaggtgctgaaggagttctctaagcagggatggagcaccgtgcgtgtgtgtgtgtatatgtgcacgtgtgtgtgtacgtgtgtgtgtgtggcaggtctagagggtcgatggctctttcctgcctcttgcccttggtatgggtaccttagtgatgcatcatggccctcccttaggacacacagcttcgcagtgccagtgaacccactccttttggctcctcctctggaatgataagcccagatgcccatgctgcccgtgaagggcttcttcttgaactgaatgtggagggcatctctggtcccggccatctgccagtgactctcatgtgcattcatgtccctctcttctctctgtcctgtcttctctgccgctgcctcttctctgcaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaagaaaaaagagaaagaaaaaaaagaatgaatgcaagctgatagctgagactgtgagactgtttttgtccactcttctgaatcactgccacttgggtcagggaccacagccattgccacccttggcccatctctctgcgtgcgtgccttgagcacacatataaaaagtgccatgtgcaattgtcttatcttttatgatctaggctttgcctagggatcactactccttaacgggctggctggggcaatgaggaaaagctcctttgctcctgtaaggccataagtggctgttaacagattttcaaatgcctgaagagattgctgagacctgctagagtcatatgttcggggaattaagtctttatcctagacaacaaggtacagatgcaaactgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcaggtggtgtgtgtgtgtgtgttttgtgtgtgtgtgtacacatgtgtttatatatacatgtgtgagggaaagtgtgtacatatatgtaggattgtaaccagacggaaaagaacgaggatctccagggtgtttgaatcagcaacagatttgtgttttctaacatgcatttagttggagaggcatggttctgtttgttttgttttgatctaatttgccattggaaataggtacagttacacagagaaggaagaaccaggaaagtgagatccatgaaactaaatgagcagctgtcagaatccagtgtggctgagcctacctagcttatgaaatctaacccagggttccctgagtccaagaccacttagattattaagattttgaacgtccagaggagtgaaaagtctgttttctgacgtaagccggagctgaggataaagccagaggccagtggattaggtgtatggaatgtggatggagagggcttgtgtgggatgtggccagggagtgggtgaggaaggccgcttctaaatggcctgtaaaaacttgagattggatagacgaaaggaaatggagaaattaaagaattggagaaactagttatctgtgttgctgactttgggacccatccaagactcctgcccttggggtgttccatggtggtttcttcctgcctgggcgccaccctttccccagttcaggccctccctggaggactagtttgtgtattggtatcctccccagtggacccaaaccagcgcatacttggtgtgtggagatgggagacaaaggacagatctaggagccttgaaggatcaccagccaccgaccctccatcagggccaactgggcaggaaagggaacattgcagacctgatttcccgacgatgtcaccctgtcctccctccttgcttcttgctctgctaactcaactctgccttcctctttttcattcttctactctgcc

SEQ ID NO: 20340 - DNA, 2894 bp, Homo sapiens
accgtcgccttttcttcttcgtcccgggcggtgcgttccactgctctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaaa

SEQ ID NO: 20341 - DNA, 2577 bp, Homo sapiens
aactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagccc

SEQ ID NO: 20342 - DNA, 4176 bp, Homo sapiens
tccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcaca

SEQ ID NO: 20343 - DNA, 4089 bp, Homo sapiens
ataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctgtgcatcgacctgggctggaagcccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcaca

SEQ ID NO: 20344 - DNA, 4388 bp, Homo sapiens
agcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctca

SEQ ID NO: 20345 - DNA, 3644 bp, Homo sapiens
aagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcagccccccgagctccccgctaacccagcccccagaggggcccaagttccctcgtgtgaagaactgggaggtggggagcatcacctatgacaccctcagcgcccaggcgcagcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggatggctctgtgcggggggacccagccaacgtggagatcaccgagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctca

SEQ ID NO: 20346 - DNA, 2294 bp, Homo sapiens
attctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtctttttcctctggatttgggtggcaacagaacacagcaggcctatgagggggtcaagcagagcctgggagatgaggaacacagatcaattccaagaagagagacaggcaatcaagacaccaatgagatcaacccaaattaggggatggtaggatatctctgacaaacccacagccaatatc

SEQ ID NO: 20347 - DNA, 1446 bp, Homo sapiens
cacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataa

SEQ ID NO: 20348 - DNA, 2537 bp, Homo sapiens
acagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggagggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacacattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 20349 - DNA, 2535 bp, Homo sapiens
gcgcatgcagcccttcccaagcactggtagggcactgggcatgcagacagcccaccagaagggaagaatcaggagaaaagggatgcaagatcccagagataaactgaagcacaagagggtaaaaactttgtccttggtcttacagccagaaagtggtgatgcaaagaacttagtccaagctttgatctgttctgcactgcctgccaaagcagaaccttgagaaatacccatgtttgggggatgagaagaagaagataaatcagcaaagaaaatagtgataagaaagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggagggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacacattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttaccttta

SEQ ID NO: 20350 - DNA, 1749 bp, Homo sapiens
gcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactc

SEQ ID NO: 20351 - DNA, 2081 bp, Homo sapiens
cttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggagcccgtctcctcttgagggtgacgtagggcagcaggtcgtggcgagtgatgatgcgcagcagctgcagcacctggcgaaagttactttcatcacagcggccctggcgctccagtgccaataagaagtcacgtccatttcggatgagtccacgctcgtggtcatcaatgacatcaacaaagaggaaagaaagcacgcgcacatctctgtgtgtcagatgagtgcccacgatgtcaaacatgcggtgcaggctgtacagcccatgttcctgctcaccatgctcttctggccacacctggcttgcccgccgctttaggcccgccatgctgggggctcaggtacgcaatgctttccagaatccctgctcagcagctgcaatccccaccgtactgaaagggcagggaaagaaccgatgagacactcaagggcaggaactagtctcatgcattcccatattcccagttgctaacaatgcctggcacagtatagtgctttatacatgtttattaaatttttgaagtgtttgtttaaaaataaacactggccaggcacaggggctcacacctgtaatcccagcattttgggaggccaaggcaggaggatcacttgagcccaggcgtttaagaccagcctgggcaacatagggagacccgtttctacaaaaaaagaaaaaattagctgggcttggtggtacacgcctgtagtcccagctgcacaggaggctgaggtgggaggaaggcttgaggccaggagttcaagatcagcctggtcaacatagcaagaccccatctctacaaaaaagaaaaaaattagcaaggcatggtggcatgtgcctgtagtccctgctactcaggaggctgaggcaggaggatcacttgagcccaggagttcaaggctgcagtgagccataatcctgcactgtagcctgggtgacagagtgagtcccccatctcggaaaaaaaagaactagtttaaattctgactgtatcactgaaaggctgtgtagctgtgtgaccgtaagcaagtcacttaactccagattctcagtgctgtcatctataaacagggatgaatgaatatacacctcagagttgttaagaatccaatgagaaaatcacgggtaacccttatataaatggttgtgaaacatttcaaagatacaagcatccttggcctttgcagcccagaatcatccctccacatttttcctacaatccaaccacatcaagaaatgataactgctcagaaagtttatcaatatttaccaaaactcatggatttaaaataaacattaagtttctacaataa

SEQ ID NO: 20352 - DNA, 1362 bp, Homo sapiens
gcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 20353 - DNA, 1518 bp, Homo sapiens
cttctggctccagaccgccctccggatcggaccctgcgaatggttttggctatatcttcatgtaggacctactccctatcccgtcggccgcggtgaatcccacctgcggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactc

SEQ ID NO: 20354 - DNA, 2092 bp, Homo sapiens
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaa

SEQ ID NO: 20355 - DNA, 2238 bp, Homo sapiens
tttaacactttaggtgatggagcgaatgaggggctgataactggagaggacgaagcaagcccccgcaacaccctccccccaaacttagcagcacgttccccattccgcaattataccggactttggtgcgaagtcactttagaaaactgggatctggaaggggccaggcgcggagtccatgtctagcctcgacgccagcctccgagtttctatttctggtgctcgagggctggggtaacggccgcggatggaggagcgaaggatgggaaaagcaaaggatgggaaaagcaaagatgggaaaagcaacggggagtgatctttccaagaaacacccaactgccccttttacctttttttgcctccattatggggcgggggttgggggggcgagagaaaaagatgtcaatgaccattgtttgctcgtttgggatgttgctccgccccccgagtctgtcgtaaacctggcgccggactaaaataaaccccagatcccgcagcccggggggctcgccgagccgccgactcctcgtcacaggctcagctgccgcggccgaggtggcggcgacgagcggccgccgcgtcctgccggcgcgcgccccaggcccccctacctggctgcccgccgagccatgtcgttgagcccaaagcacacgacgcccttctccgtgtccgacatcctgagccccatcgaggagacctacaagaagttcagcggcgccatggacggcgcgccacccggcctgggggcgcccctgggggccgcggccgcctaccgcgcgccgccacctgggccctcctcgcaggcggcgaccgtggcgggcatgcagccttctcacgccatggcgggtcacaacgcggcggccgcggcggcggcggcagcagctgcggcggcggcggccgccacctaccacatgccgcccggcgtctcgcagttcccgcacggcgccatgggcagctactgcaacggcggcctgggcaacatgggcgagctgcccgcctacacggacggcatgcggggcggcgcggccaccggctggtacggcgccaacccggacccacgctactcgtcaatctccaggttcatggggccgtcggcgggcgtgaatgtggccggcatggggtcgctgaccggcatcgcggacgccgccaagtcgctgggcccgctgcacgcggcggcggcggcagccgctccgcgaaggaagcgccgcgtgctcttctcgcaggcgcaggtctacgagctggagcggcgcttcaagcagcagaagtacctgtcggcgcccgagcgcgagcacctggccagcatgatccacctgacgcccacgcaggtcaagatctggttccagaaccaccggtacaagatgaaacggcaggccaaggacaaggcggcgcagcagctgcagcaggagggcggcctgggcccgccgccgcctccgccgccgtccccgcgccgcgtggcggtgcctgtgctggtcaaggacggcaagccgtgccagaacggcgccagcacgcccacccccggccaggccggtccgcagccgccggccccgacgccagcacctgagctggaggagctgtcgcccagcccacccgcgctgcacggcccggggggcggcctggcggccctggacgcggccgccggggagtacagcggcggcgtcctgggcgccaacctgctctatggcaggacgtggtgacagcgagggcgccccggggctaggtcctggtgcacccgaagggtctgcaagaaactgctagaacggatgggggaggcatgcgaaaaccgactcgcgcgtgtaaactgcgattcaaaacgaaccggtctcagagaggagcaggctgtgaacctcttgctgggggcgggggacagcgacagcccggaaaccgagtagtgtaacattatgccacgaggctttgaggtggtgattttctcctcctagaagttcttaaatgacgcgaaaaggtggagaagttcacacggcattcttaactacagctctcaaagttggaaactttgttggcgtttgtaactataaaaatcaacccagctttaacaatcagtcctttttgaagtggaatttatcttgggagattaattttcgaagggccccctaagtgcaatttcattaatgtttgattgaaagtaaattgaagtgtagctcaaggtggatcatacacatagcaacattattgcagaggaattattgccatttaggtaatagagcaatggaatcaaaataa

SEQ ID NO: 20356 - DNA, 1709 bp, Homo sapiens
tttttttgccgtatgactatattaggtgacacgaaactgctcatcgctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttga

SEQ ID NO: 20357 - DNA, 1124 bp, Homo sapiens
ctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcagg

SEQ ID NO: 20358 - DNA, 1027 bp, Homo sapiens
acatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgca

SEQ ID NO: 20359 - DNA, 906 bp, Homo sapiens
atgctgctgagccccgtcacctccacccccttctcggtcaaggacatcctgcgactggagcgcgagcggagctgccccgcggcttcgccacatccgcgggtgcggaagagcccggaaaactttcagtacctgagaatggacgcagagccgcgagggtcagaggttcacaacgctggtggcggcggcggtgacagaaagctggatggttcggagcctcctgggggtccctgtgaggcagtcttggagatggacgcggaacggatgggggagccacagcccggcctgaacgcggcctcgcccctcggcggcgggaccagggtgccagagcgcggcgttggcaacagcggcgacagcgtgcggggtggccgctcggagcagcccaaggcgcggcaacgacggaagccgcgcgtgctcttttcgcaggcgcaggtgctggccctggagcggcgcttcaagcagcagcggtacctgtcagcgcccgagcgcgagcacctggccagcgcgctgcagctcacgtccacgcaggtcaagatctggttccagaaccgacgctacaaatgcaagagacagcgccaggacaagtcgctggaactggctggccaccctctaacgccgcgccgagtagctgtgcccgtcctggtgcgcgatggcaagccctgcctgggccccgggcccggcgcacctgccttccccagcccctacagtgcagcagtgtcgccctactcttgctacggaggctacagcggagcaccctacggcgcaggctacggcacctgctacgcgggcgcgccctcgggtcctgcgccacacacaccactggccagcgcgggcttcggacacggtggccagaatgccaccccgcagggccatctggcagccacgctgcagggtgtcagggcctggtga

SEQ ID NO: 20360 - DNA, 717 bp, Homo sapiens
gacagaaagctggatggttcggagcctcctgggggtccctgtgaggcagtcttggagatggacgcggaacggatgggggagccacagcccggcctgaacgcggcctcgcccctcggcggcgggaccagggtgccagagcgcggcgttggcaacagcggcgacagcgtgcggggtggccgctcggagcagcccaaggcgcggcaacgacggaagccgcgcgtgctcttttcgcaggcgcaggtgctggccctggagcggcgcttcaagcagcagcggtacctgtcagcgcccgagcgcgagcacctggccagcgcgctgcagctcacgtccacgcaggtcaagatctggttccagaaccgacgctacaaatgcaagagacagcgccaggacaagtcgctggaactggctggccaccctctaacgccgcgccgagtagctgtgcccgtcctggtgcgcgatggcaagccctgcctgggccccgggcccggcgcacctgccttccccagcccctacagtgcagcagtgtcgccctactcttgctacggaggctacagcggagcaccctacggcgcaggctacggcacctgctacgcgggcgcgccctcgggtcctgcgccacacacaccactggccagcgcgggcttcggacacggtggccagaatgccaccccgcagggccatctggcagccacgctgcagggtgtcagggcctggtga

SEQ ID NO: 20361 - DNA, 1829 bp, Homo sapiens
attcaggtacttaacaccctggagacccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagttcgagaataaaatgtgtggggttgggtcccctgcgcgcctgcggggaacgtaggcgggagtcgtgccccccagaccggtgttcgcatcgctggctcgccccttgactggctaagtggggcccggccccagctggatcgaagggcgggttgcagtcccgacacggctttaggaagatacctgggggatggaggggtggtgatgtcagggttgggcgcgggaagaaaaggagaggaggaagctgaggcaactttgggattcttgtcagcgggaggcgtcactggccccagagtgactccgactctccgctgggctcccagagctgctggcgtttcgaataccgaaaagtcaaccctgtggaccacgacagggcagaaggagtttctccggagatgagccggcgaggccaggtgcggggcgcgctgcaccggagcagcccaggccgggccgcaagctgtttccagagtgcaggagccaagtgctcggggaccctttgaaaagtgcctggggacctgaagagcaccggggaatttgtaacccctatttaagcctgcaagtgcctaagtta

SEQ ID NO: 20362 - DNA, 2801 bp, Homo sapiens
cgggaggggggtggtacagtggaacgcaagggaaggaaagagaaaagaaacagataaaaccagggcagggggtaaaaaagttccccgcgcctctcggaatccagcggccgcggccgcggctaccgccgccgccgccgggggtgggctccggaagagcctgcccagcagggaaggggaggacgggccaggagcgaaatcctgcaggcgaggaagggacagacgcgcaaagaaaaagtgactcgggctgtgcgccccggcggcgctcgggaggggactgctgccacggaggggcccccgccaatcctccttcacgtcccccgagggggcagaccccagcccgcccctaagggcgagaagcgatgagataatccagctgagctgcgaaaggagagcgtctggctctggattcggggggagggggtctccgggcggggtgggcctctaaggtgggggcgagggtcggcgctgatcctgggacggagtggggcgggagctgctgggccgcgcagcagtgggcggcggcggcctcgcacacccagctcactcgcgctgcggccgccggcgctctctgtcccgctcggagctgctcggcgccccagctgcccgccccgccggccgctcctgcccgcggcgcagatggctgtgcgcggcgccaacaccttgacgtccttctccatccaggcgatcctcaacaagaaagaggagcgcggcgggctggccgcgccagaggggcgcccggcgcccgggggcacagcggcatcggtggccgcggctcccgctgtctgctgttggcggctctttggggagagggacgcgggcgcgttggggggcgccgaggactctctgctggcgtctcctgccggtaccagaacagctgcggggcggactgcggagagcccggaaggctgggactcggactccgcgctcagcgaggagaacgagagcaggcggcgctgcgcggacgcgcggggggccagcggggccggccttgcggggggatccttgagcctcggccagccggtctgtgagctggccgcttccaaagacctagaggaggaagccgcgggccggagcgacagcgagatgtccgccagcgtctcaggcgaccgcagcccaaggaccgaggacgacggtgttggccccagaggtgcacacgtgtccgcgctgtgcagcggggccggcggcgggggcggcagcgggccggcaggcgtcgcggaggaggaggaggagccggcggcgcccaagccacgcaagaagcgctcgcgggccgctttctcccacgcgcaggtcttcgagctggagcgccgctttaaccaccagcgctacctgtccgggcccgagcgcgcagacctggccgcgtcgctgaagctcaccgagacgcaggtgaaaatctggttccagaaccgtcgctacaagacaaagcgccggcagatggcagccgacctgctggcctcggcgcccgccgccaagaaggtggccgtaaaggtgctggtgcgcgacgaccagagacaatacctgcccggcgaagtgctgcggccaccctcgcttctgccactgcagccctcctactattacccgtactactgcctcccaggctgggcgctctccacctgcgcagctgccgcaggcacccagtgaacccgcttgggctgaggcagcgagtgattcccgcgctccggctccggaccggcgctgacagctgtaggctgtagcctgcacggggcgccccgccaaggaggcacctggaggtgaaacccagctccagctcccgttagccaggacttgtcccctggcagctgggctgagtctgccctgagggggcgcctttttctaatttgaacagaggcaccctatggcctaggggccctgatcgcccacctgcctggaagcccctgggctctatttattatcatgacaatgttggaattaaattttgattcgaatatgtctgcctgggggtggggttttccctgagcggcaactcctggagaccacatagcctgaatcctcagaatttcaggcctgctgggagctttctgcactaggccacactagttcatggtatccatgctaccaatctatgtgtatctacatatcttttatttttggaaattgcatttgtaaccaaggggtgcgaaaccctggcagtcccaggcagcaccaggccaggggttgatttgaaacgtgaaggattgggttttcaggccctctgctccacccctcctgtgtgtcagagctagggtgggggtgcccgattcgggtgctgaatgtaaggaggggagcctccaagtgtggtgcaagccgggggtctccacatcttccttctctgaagtccaggtacctgcacaagcaggaagcgcctgggagtcccggaaggaggagagcgcacacccaggcagccctctgcggaaactttccttggtttctttttatttgtgtaaaggaggttaagacgtgtcgcacttttcagttgtttgtattcaaatgacgattatttttctactcaatgtgaatatccctggccagcctttccacggcgcccaccgcagtgccgctgcctggccctcagtgtctaccttctgccctctgcgactccagtgctctggcccgggactcccctatccgcccctcacttacccttaaacaggtgatcccacctgtcttgtcaacctcgccgcttttcgcctccttaatggcactgtgcactcaactagagtattaactgtaaaaagatttgtgaagtttggaagctctattcgctgtattttttctttaatttataaacttttagtttaacatgc

SEQ ID NO: 20363 - DNA, 937 bp, Homo sapiens
atggagtccaacctgcaggggacgttcctgctgaacaacacgccgctggctcagtttccggagatgaaggccccggtgtgccagtactctgtgcagaactccttctacaagctcagccccccagggctgggcccccagctggccgccggaaccccccacgggatcacggacatcctgagcaggcccgtggctgcgccgaacaacagcctcctctccggctacccccacgtggcaggctttggggggctcagctcgcagggggtctactacagcccccaggtagggaatttttccaaggctgggaacgagtacccgacccggacccggaactgctgggcggacacgggccaagactggcgaggcgggcggcagtgcagcaacaccccagaccccctgagtgacagcatacacaagaagaagcacacccggcccaccttcacggggcaccagatctttgccctggagaaaacctttgagcagaccaagtacttggctggccccgagagggcacggctggcatactcactgggcatgaccgagtcgcaggtcaaggtgtggttccagaaccgcaggaccaagtggcggaagaagagcgccctggagccctcgtcctccacgccccgggccccgggcggcgcgggtgcaggcgcaggcggggaccgcgcaccctcggagaacgaggacgacgagtacaacaagccgctggaccccgactcggacgacgagaagatccgcctgctgctgcgcaagcaccgcgccgccttctcggtgctcagcctgggagcgcacagcgtctgacgcccgccgtccaggcccgggatcctggctgcagcctgcggggggacgccgaggagcctaccttcccctccccttccccacgctcctgggggcgcagggactgagtctttctttggatgaggggcgcgtggaggaggag

SEQ ID NO: 20364 - DNA, 1683 bp, Homo sapiens
aaggatgcagcaggggcagctggcacctgggtctaggctttgctcagggccctggggcctccccgagctccaacccgctgcgccctcctcatcagccgctcagctgccctggggcgagagctggggggaagaagcagacactcctgcatgtctttctgcttctggggtgtggttccagaaccgcaggaccaagtggcggaagaagagcgccctggagccctcgtcctccacgccccgggccccgggcggcgcgggtgcaggcgcaggcggggaccgcgcaccctcggagaacgaggacgacgagtacaacaagccgctggaccccgactcggacgacgagaagatccgcctgctgctgcgcaagcaccgcgccgccttctcggtgctcagcctgggagcgcacagcgtctgacgcccgccgtccaggcccgggatcctggctgcagcctgcggggggacgccgaggagcctaccttcccctccccttccccacgctcctgggggcgcagggactgagtctttctttggatgaggggcgcgtggaggaggagcagcaggtgcaggggaggaggaggggaggcgggggaggaggaggaaaaggagggaaaggggacaggcatcctagctaagggaggaggaggccaggagggaggcacagcactcctgagacctggaagccgctgccccttgcacctcctcgggcctcgcctgccagttctgcagattcacaagtggacagaggactaaaatgaccaggctctgcagccaagaaactggctgtggggtcccagacatgccactgtgatccagctgttggggcggggggagtgggcaggacttcccagggagggaggcagctggctggggagtcagaagtccagagtcttgggccccaagccagctgctggctgcagaagaaaagacaggtgagtggccaggtgcactcctcagacctgtgcacaggaagggtcccactggaggggccagagctgagcacctaacccaggctgcaggaaatctgcctccaggaggggaagtgggacatcccagtggagaaaaaatgcccctgacactgcaggatgacggcccctgagctgcggaaatccccctggcctcctttctccgatttaccctcagggtcaatacctctgagaccgctgtgccctcctcatcctgacagccggggaaaaggggagggtgcagggagaggggaggcggggacggtgtgcccaagggccacccacctgggcatcatttggtgctgatataaggacaggcccacccagagagaaaaagcatcccacctggggaggaaaggaagggctgggaaagaccccagaacggcacccctccaacaaggcaggaagggagaaggacagcccctccggctgggtggaggatgccaggaaggggctgaaccacggcctgctgggaatcacggcccttcctttcctcagatcgccttgcggcctggcactggagctggtgctgacagggacgctggccaacagggtggtatttttcacccgggtgatctgagctgctggcaggtagggggtgggctgggggaggcgggtgagggctggtcttagataggaatgcagcccagaagggaccaagcacttgcccatcctcactggctttcaaaaaataaacagtaaaaataaaagtcccatgaacctt

SEQ ID NO: 20365 - DNA, 3744 bp, Homo sapiens
cccgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctacc

SEQ ID NO: 20366 - DNA, 2942 bp, Homo sapiens
gtctgggctctgaagaggaccggatacataaggcagaacccaaggaagccttaggctcaggtctctgcctgaaggacagaagtcggtcctaggccccccaggctctgaccttctttcccaggatgaggtggggccaccatttgcccagggcctcttggggctctggttttagaagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttct

SEQ ID NO: 20367 - DNA, 4092 bp, Homo sapiens
cgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggtgggcaggaagcgccacgccgaggagccggggactctgggagctagcgggagacgccggcgtccgcccagccgacccctctgggccgcggccgacggctcccggaactgggcagccgcgggtaaaggcctagcgggcttgataacccctgcgccctggctgggaggccgcgctgagcggggggcagggcgggccgggggaggaggctgtgcaagggccgcggggagatcccggccgagaacgagagggacggagctgggcgctgaatggcgggcgttctggcaagtctccccctgcgttcccgaggccacccgaaagtaggagagctgtttgggacccagtttggtggaggagctctggacctgtaggaacaccgcccctgacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaa

SEQ ID NO: 20368 - DNA, 3039 bp, Homo sapiens
cgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctacc

SEQ ID NO: 20369 - DNA, 3716 bp, Homo sapiens
gcccgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttcta

SEQ ID NO: 20370 - DNA, 2850 bp, Homo sapiens
gacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaa

SEQ ID NO: 20371 - DNA, 4170 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 20372 - DNA, 3828 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 20373 - DNA, 3996 bp, Homo sapiens
gatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 20374 - DNA, 4318 bp, Homo sapiens
gcatttcctctctagctgttcctgaggctggcatctggatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaatttt

SEQ ID NO: 20375 - DNA, 2940 bp, Homo sapiens
atgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtag

SEQ ID NO: 20376 - DNA, 3853 bp, Homo sapiens
gcatttcctctctagctgttcctgaggctggcatctggggaaacctttcttccatggctcaggacacactcctggatcgagccaacaggagaactttctgtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaa

SEQ ID NO: 20377 - DNA, 3049 bp, Homo sapiens
gcatttcgctcgcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaa

SEQ ID NO: 20378 - DNA, 3061 bp, Homo sapiens
ggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccaggtgagatggaggtcagcggcagagctgggtggcccgagggtcttgcagctgggaagctcaggaaatcccatggtcctcatcttaaagttctttttaacgaacttacccagtggagttgggtttccttctttcctgctttttcgaagttctgtgaatatattaattattcagagagactggaggaagacgtaaaaagaggagactaggtaaagtgatttaaatcccaacattctcttttttttttttttttttttttttttttttaaaagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaag

SEQ ID NO: 20379 - DNA, 547 bp, Homo sapiens
caaacgccccgggtcgctacccggatttgacggtggctggagcggcacgggcgacgcaagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgt

SEQ ID NO: 20380 - DNA, 1077 bp, Homo sapiens
acagccaggttggcagctgacgggacagccggggtctattttgttgcgggttttcagcaaatccagggctggtctggaggcgcgaagtaggttccggagtccgagacctgggctgtcggccgcgggcccctgagtagcggatggggcgggctccccggcctcggggccgtgctcagtctgcgtgagcgccgcgtgcccggaacccgtgtgcggtcgcgccccggggttgggggtcggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtag

SEQ ID NO: 20381 - DNA, 589 bp, Homo sapiens
cccaatccctccgacatccctgcgccggggcccttccctagcgctccgggaaagcgttcgccgcaggcctgttaggggcccaccaataccgtaacaccgttcccgtcctcttcctcggcaccgctgcaaacgccccgggtcgctacccggatttgacggtggctggagcggcacgggcgacgcaaggcagatgcggactgaattacaccgctggctttccttgttctccagcttgcaggcagcatactgtgggacttctgggcctccataattgtaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgca

SEQ ID NO: 20382 - DNA, 685 bp, Homo sapiens
tcggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccaggtgagatggagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaag

SEQ ID NO: 20383 - DNA, 746 bp, Homo sapiens
atacgtcactcgggccgcgggatttcgagcatttcgctcgcgagatcttctctgtggcggagacagccagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtag

SEQ ID NO: 20384 - DNA, 2048 bp, Homo sapiens
aaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagttcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgcc

SEQ ID NO: 20385 - DNA, 7209 bp, Homo sapiens
gacgtcatcacgcagggccgagtcggcgcggccacatcctttaaatatggtcttttttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcaggaaggaaattttgtttataagttatttagcctgcaagacctgttgttactcgtacgctgcagtgtccagaggatagagacaagaccacgttctaaaaaacggaagaaaatcagaagacaatttccagtttatgtactaccaaaagtagagtatcaagcttgttatggagttgaagctctgactgaaagtgaactttgtcgcttatggactgaaagtttattgcattccaacagctcattttatgttgggcatatcgatgcatttacttcaaaactttttctactggaagaaattacctcagaagaattaaaagaaaagctttcagcactcaagatttccaatttatttaacatcctccaacacattctaaagaaactaagtagcttgcaggagggttcctacttgttatctcatgcagcagaagattcttcactcctgatttataaggcctctgatggaaaagttactaggacagcatacaatttgtataaaacacattgcggccttcctggtgtaccttccagtctctcagttccctgggtcccattagatcccagcctgttattaccatatcatatccatcatggaagaataccttgtacttttccaccgaaatcactggataccacaacacaacaaaagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaacagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttgaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaaaacttggtgaaattccattacagaagccaaaaataaaaactccctgcctctgaaaagtcagattactgacttcttgtttggcaaccatcagtttgtttaataaaagaaaaaatttggtggtataacatgtttgatgacagatgcctctatctctagattcaagctgagtgttgaaatacactgctgaaagcaaagagataggtatgttttccagaaaaaaagtcagtgtcattgctccagatgacaaggttaatgtggtaaagcataagcttttttttttttttgagatggagtctcgctctgttgcccaggctggagtgcagtggcatgatctcagctcaccacaacatccacctcctggattaaagcgattctcctgcctcatcctcccgagtagctgggactacaggcacctaccaccaggcttggctaatttttttttgtatttttagtagagacagggtgttaccatgttggccgggctggtctcaaactcctgaccttgtgatccgcctgccttggcctcccaaagtgctgggattacaggggtaagccaccgtgcctggccagcataagctatttttatcctcatctatactgattgatttaaattttccgggcctgcagatgaatttggaaaagggcataatcaactgatgttgctgtagcaaatttggacttaagaaactacagacagggccgggcgtggtggctcacacctgtaattccagcacttcgcaaggccgaggcgggagaatcacttgagtccaggggttggagaccagtctgggcaacacagacctcatctctacaaataaaaaagttagccgggtgtggtggggtgtgcctgtagtcccagctactcaaaaggctgaggcagaagaattgcttgagcccaagaagtcaaggctacagtgagttgtgatcgcaccacagaactcagcttgagtatcagagtgtgaccctgtctcaaagaaaaaaaaaaacaggacaggcttgtttaatctttagaacccttacactaaaattttcagaaattatgtatgtcatttgtaaaatataagttttgtaatcctagataattgcttcacattgaaattttttagctattctgtgtaaagaatagctattcttttggcctaatttctgagaaattagaccgaaaaatctcctcaagtattgtaacagttgaaaatacttatattcaactaccaagttttgtttcattttgattttttgttataaaacatttttaagttatttgagaagtaattattagtaaaattgtatcttgataaatcatttcctcatcctgccattcccttttataaaacactgagtttttttattccttaagtcacatatcccagaaatgttttggttgtgaatcatttgccagcgagccaagggagaggcagggattcccttgaaatgtactcttacacttttttattttatttttaatgtacatttgtgtgcaccagaatggaatgtgctctttttaaagagctggacagtggttgcttcagacttctgaataccagaaagacttgccttttaatttttaaatattactttttacatcataaaatgtgttatcttatccatgtatttgaataacatcatatataaaggtagttttttgcttgtgcttagtgaagcctccttttttaacatacatttgatatgctttatgttctttttcttgatttttagtactgagaatttataagccaagaagtaactgacaatatgtttagcaggatgtaatcccagctacttgggaagctgaggtgggaggatcgcttgagtctaggagtttgaggctgcagtgagctatgatggtgccactgcactccatcctgggtgagagatcaagaccctatctcaaaaaatgagcaagttttttttttttttttaaatcagacttagggctagcaaggatgtgatcaccctggcccatttatacctcagcagtgaaggtgtaatttatacacacctctttgaaaacagtttaattcagtaagtgagtgcaactatgtgccatgcactccaaagtaggtccccacagttattctctcatagccttgttttttcagatctcaccatatttatttgtttctttgattttcttttcttatagattacaagctctgcaaggacaggggcatatttgttttgttcaccattaagtaataaacacctaatacagtgcctgtcatgtagttgcttagcagatattagttagatgcatgaatgtgtaggtatcaaagattttttttttcaggagatcacattctagtggaagacactatactgctttatgtgataagtgctttgataaagtaagcaagtcatctaaccagatcttggtagttaaggttttctgagatagaacttgagctgagtcttttaaaaatagtaggatttataagggaaaattaaaggtcttccacaaagaaactaagtgaaactaagcagcctatgaaaaggtgaaagttggagagattataggctatgaacatgggagatgagagagaaaactgcaggatagggacagaaacactgtgctaagacatttgaactttgtcctgtgcaatgtgggaaccagtagtgaaggttaattaactgacatgatcagatatgtatttgaaaagggctcttgttggcattagtctagagaatgcgatggagctgggaagcgaaagaagaaatgttgggagcctgtgttgtagtaactgaaaaatggcaatggcccagaattaaagcagcaagaataggagtgggctcaagtgatgtataaggaaaaaaaaaaaaatgacaactcagttttgttgttggtaaggagagtaaagtatggcttctgggtttctcatttgagatactgagtaaatgatggtgttaacccattgagaaaatagtgtggttagagtgggaagaaagttaatttaaaatgttcatttttttttttagtcatttctacttttggattctaggtttgtgtgctatattggttataaccaatttgctgaataataaattatcccaaaacttagctacttaaaacaacaaacattatctcacagtttctgtaagtcaaaagtccaggtctctcatgaagttgcagtcaggctcttggctagggctgcagtcatctgaaggattagtaagtcgctaagcccacacttaagctccacccttgaagggagaagtttggaaagaatttgtgaacatatttttaaatcacatatgctatgaacaggtttaggggagggagaggaaagaaaactttaacttttcattagcatactgcatctgtagttcctaatgggcatgttgtaaagatgttaagacgttttctatgcattataggtatatagtagtattttgttttgttctgtttttttgtttggtatgtagtagtttttaatcaaaccttaacgtatttgatattaagatttattgagtttcttgttgagatgtagaaataaaggggatccatttcatttatcca

SEQ ID NO: 20386 - DNA, 7049 bp, Homo sapiens
gacgtcatcacgcagggccgagtcggcgcggccacatcctttaaatatggtcttttttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaatcaaatctttcatgaagttccattaaaatttatgatgtccaaaaacacatctgttccagtctctgcagtctttatggacaaacctgaagagtttatatctgaaatggacatgtcctgtgaagtcaacgagtgccgaaaaattgagagtcttgaaaacttgtatttggattttgatgatgatgtcacagaacttgaaacttttggagtaaccaccaccaaagtatcaaaatcaccaagtccagcaagtacttccacagtacctaacatgacagatgctcctacagcccccaaagcaggaactacaactgtggcaccaagtgcaccagacatttctgctaattctagaagtttatctcagattctgatggaacaattgcaaaaggagaaacagctggtcactggtatggatggtggccctgaggaatgcaaaaataaagatgatcagggatttgaatcatgtgaaaaggtatcaaattctgacaagcctttgatacaagatagtgacttgaaaacatctgatgccttacagttagaaaattctcaggaaattgaaacttctaataaaaatgatatgactatagatatattacatgctgatggtgaaagacctaatgttctagaaaacctagacaactcaaaggaaaagactgttggatcagaagcagcaaaaactgaagatacagttctctgcagcagtgatacagatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaatttgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcaggaaggaaattttgtttataagttatttagcctgcaagacctgttgttactcgtacgctgcagtgtccagaggatagagacaagaccacgttctaaaaaacggaagaaaatcagaagacaatttccagtttatgtactaccaaaagtagagtatcaagcttgttatggagttgaagctctgactgaaagtgaactttgtcgcttatggactgaaagtttattgcattccaacagctcattttatgttgggcatatcgatgcatttacttcaaaactttttctactggaagaaattacctcagaagaattaaaagaaaagctttcagcactcaagatttccaatttatttaacatcctccaacacattctaaagaaactaagtagcttgcaggagggttcctacttgttatctcatgcagcagaagattcttcactcctgatttataaggcctctgatggaaaagttactaggacagcatacaatttgtataaaacacattgcggccttcctggtgtaccttccagtctctcagttccctgggtcccattagatcccagcctgttattaccatatcatatccatcatggaagaataccttgtacttttccaccgaaatcactggataccacaacacaacaaaagattggtggaacgagaatgcctacacgcagccacaggaatccagtttccatggaaaccaaaagcagttgcttgcctgctcagcaagttgaaactgaaggagtggctccacataaaagaaaaataacttgaggactgtaccatggaaaactaaatttaaaaaaacagttataacagtgtttaatttagataagtttgagggaaaataatcagtaggcaagaggaacatttttcctgtagtagctagagtgccttgaaaaaatgtgttggctatgtgaaggaatatttcaactaaaatggaatggtatgcttttcacccttgaagtttgaggaggatcttgatatgttttaacattatcatggcagggaaatatataaagaagaaaaatatttttacattaaaccttttctaaaaattgtaaatagaaaaataatttggttttttatcaagaacaacacttatcgttatgtattgtgttagttatattgccagtctgttgcgactgactcaaaaagttaaatgttgccactgctgaagatgattatgagcatcgcaaactttgtttctgacccattttgacagtttttatatactcctttaaaatgatgaatgttacaggttaataaagttaatacctttaaaaacttggtgaaattccattacagaagccaaaaataaaaactccctgcctctgaaaagtcagattactgacttcttgtttggcaaccatcagtttgtttaataaaagaaaaaatttggtggtataacatgtttgatgacagatgcctctatctctagattcaagctgagtgttgaaatacactgctgaaagcaaagagataggtatgttttccagaaaaaaagtcagtgtcattgctccagatgacaaggttaatgtggtaaagcataagcttttttttttttttgagatggagtctcgctctgttgcccaggctggagtgcagtggcatgatctcagctcaccacaacatccacctcctggattaaagcgattctcctgcctcatcctcccgagtagctgggactacaggcacctaccaccaggcttggctaatttttttttgtatttttagtagagacagggtgttaccatgttggccgggctggtctcaaactcctgaccttgtgatccgcctgccttggcctcccaaagtgctgggattacaggggtaagccaccgtgcctggccagcataagctatttttatcctcatctatactgattgatttaaattttccgggcctgcagatgaatttggaaaagggcataatcaactgatgttgctgtagcaaatttggacttaagaaactacagacagggccgggcgtggtggctcacacctgtaattccagcacttcgcaaggccgaggcgggagaatcacttgagtccaggggttggagaccagtctgggcaacacagacctcatctctacaaataaaaaagttagccgggtgtggtggggtgtgcctgtagtcccagctactcaaaaggctgaggcagaagaattgcttgagcccaagaagtcaaggctacagtgagttgtgatcgcaccacagaactcagcttgagtatcagagtgtgaccctgtctcaaagaaaaaaaaaaacaggacaggcttgtttaatctttagaacccttacactaaaattttcagaaattatgtatgtcatttgtaaaatataagttttgtaatcctagataattgcttcacattgaaattttttagctattctgtgtaaagaatagctattcttttggcctaatttctgagaaattagaccgaaaaatctcctcaagtattgtaacagttgaaaatacttatattcaactaccaagttttgtttcattttgattttttgttataaaacatttttaagttatttgagaagtaattattagtaaaattgtatcttgataaatcatttcctcatcctgccattcccttttataaaacactgagtttttttattccttaagtcacatatcccagaaatgttttggttgtgaatcatttgccagcgagccaagggagaggcagggattcccttgaaatgtactcttacacttttttattttatttttaatgtacatttgtgtgcaccagaatggaatgtgctctttttaaagagctggacagtggttgcttcagacttctgaataccagaaagacttgccttttaatttttaaatattactttttacatcataaaatgtgttatcttatccatgtatttgaataacatcatatataaaggtagttttttgcttgtgcttagtgaagcctccttttttaacatacatttgatatgctttatgttctttttcttgatttttagtactgagaatttataagccaagaagtaactgacaatatgtttagcaggatgtaatcccagctacttgggaagctgaggtgggaggatcgcttgagtctaggagtttgaggctgcagtgagctatgatggtgccactgcactccatcctgggtgagagatcaagaccctatctcaaaaaatgagcaagttttttttttttttttaaatcagacttagggctagcaaggatgtgatcaccctggcccatttatacctcagcagtgaaggtgtaatttatacacacctctttgaaaacagtttaattcagtaagtgagtgcaactatgtgccatgcactccaaagtaggtccccacagttattctctcatagccttgttttttcagatctcaccatatttatttgtttctttgattttcttttcttatagattacaagctctgcaaggacaggggcatatttgttttgttcaccattaagtaataaacacctaatacagtgcctgtcatgtagttgcttagcagatattagttagatgcatgaatgtgtaggtatcaaagattttttttttcaggagatcacattctagtggaagacactatactgctttatgtgataagtgctttgataaagtaagcaagtcatctaaccagatcttggtagttaaggttttctgagatagaacttgagctgagtcttttaaaaatagtaggatttataagggaaaattaaaggtcttccacaaagaaactaagtgaaactaagcagcctatgaaaaggtgaaagttggagagattataggctatgaacatgggagatgagagagaaaactgcaggatagggacagaaacactgtgctaagacatttgaactttgtcctgtgcaatgtgggaaccagtagtgaaggttaattaactgacatgatcagatatgtatttgaaaagggctcttgttggcattagtctagagaatgcgatggagctgggaagcgaaagaagaaatgttgggagcctgtgttgtagtaactgaaaaatggcaatggcccagaattaaagcagcaagaataggagtgggctcaagtgatgtataaggaaaaaaaaaaaaatgacaactcagttttgttgttggtaaggagagtaaagtatggcttctgggtttctcatttgagatactgagtaaatgatggtgttaacccattgagaaaatagtgtggttagagtgggaagaaagttaatttaaaatgttcatttttttttttagtcatttctacttttggattctaggtttgtgtgctatattggttataaccaatttgctgaataataaattatcccaaaacttagctacttaaaacaacaaacattatctcacagtttctgtaagtcaaaagtccaggtctctcatgaagttgcagtcaggctcttggctagggctgcagtcatctgaaggattagtaagtcgctaagcccacacttaagctccacccttgaagggagaagtttggaaagaatttgtgaacatatttttaaatcacatatgctatgaacaggtttaggggagggagaggaaagaaaactttaacttttcattagcatactgcatctgtagttcctaatgggcatgttgtaaagatgttaagacgttttctatgcattataggtatatagtagtattttgttttgttctgtttttttgtttggtatgtagtagtttttaatcaaaccttaacgtatttgatattaagatttattgagtttcttgttgagatgtagaaataaaggggatccatttcatttatcca

SEQ ID NO: 20387 - DNA, 1470 bp, Homo sapiens
aggggcgggaggagggaacatggcggccgggccaggaccctttgctcctggctctgcgcggctcctacccctgctttgcttgcccttttacctgcttttctggaaccttgtttcccctctctttgcgtcccctttccctcagccgtttcttttgccttcctcgactattcccccccagctccacactgggtcgaagtgtgagaggtagattaagtgggagccggtcgggcccgttcggtgtcgagagaccgactcctaaatttgattaggttctcgcaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaaccagttaaagtaatatatattaattcaccacttccccaaaagaaaatgactatgagagagagaaa

SEQ ID NO: 20388 - DNA, 559 bp, Homo sapiens
aaatatggtcttttttgggcgcgcgcgacaatctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaa

SEQ ID NO: 20389 - DNA, 584 bp, Homo sapiens
aaatatggtcttttttgggcgcgcgcgacaatgtgaggagtggggtggagcgtgtgtggtgtgtggctgcggcctgggcaagagccgccgcggaccatgaggttctcgcaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtt

SEQ ID NO: 20390 - DNA, 568 bp, Homo sapiens
cacatcctttaaatatggtcttttttgggcgcgcgcgacaatgtgaggagtggggtggagcgtgtgtggtgtgtggctgcggcctgggcaagagccgccgcggaccatgaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttat

SEQ ID NO: 20391 - DNA, 1028 bp, Homo sapiens
gtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttct

SEQ ID NO: 20392 - DNA, 1623 bp, Homo sapiens
taccttataaaatacatgcaaaaaactggttttagaaagcgttccctaaaattagtgtgtacggaaacttcaggtatacttctgctttcctccgcaaaaccacccctttttaaaaatcgaaagtgaaattagtttttttttctgttagtgactaatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaaactagagctgagcttttcaaagtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttatagatta

SEQ ID NO: 20393 - DNA, 581 bp, Homo sapiens
gacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcggtagagacggggtttcaccgtgttaaccaggatggatacgatctcctgacctcgtgatccgcacgcctcggcctcccaaagtgctgggattacaggcgtgagccaccgcgcccggccctcgctgttttctccgagtgtctctggagatagtccttaggaaaacggatttcttaagaaaacgattcttggggatcatggaagctgataaagatgacacacaacaaattcttaaggagcattcgccagatgaatttataaaagatgaacaaaataagggact

SEQ ID NO: 20394 - DNA, 3014 bp, Homo sapiens
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 20395 - DNA, 2818 bp, Homo sapiens
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcg

SEQ ID NO: 20396 - DNA, 3755 bp, Homo sapiens
acacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 20397 - DNA, 729 bp, Homo sapiens
agtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 20398 - DNA, 550 bp, Homo sapiens
gagaggctggtggcgcttcagtcccgtagcacacacagggcggtgtgcatgtgtgagtgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 20399 - DNA, 709 bp, Homo sapiens
aaacctcgcctggctcccagctggtgctgaagctcgtcagttcaccatccgccctcggcttccgcggggcgctgggccgccagcctcggcaccgtcctttcctttctccctcgcgttagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagca

SEQ ID NO: 20400 - DNA, 581 bp, Homo sapiens
aaaggggccgcccgtgcggtgccgctggagcgccaggaccgccctttgtagccccgcgtactccaggagtaagcgccccggagctgcaagcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 20401 - DNA, 1442 bp, Homo sapiens
acaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcc

SEQ ID NO: 20402 - DNA, 2346 bp, Homo sapiens
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 20403 - DNA, 2918 bp, Homo sapiens
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 20404 - DNA, 2918 bp, Homo sapiens; identical to SEQ ID NO: 20403

SEQ ID NO: 20405 - DNA, 4879 bp, Homo sapiens
ctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctg

SEQ ID NO: 20406 - DNA, 1066 bp, Homo sapiens
gcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctggctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaaggccccaaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgccatttggagatggtggggggcggtactggtggtttgtttttgttttta

SEQ ID NO: 20407 - DNA, 4999 bp, Homo sapiens
caggccggctcagcgggcgaggcgggacctcgggagcgcgcgcctgcagaccggacgtccggccagcaggcggggccgggagaggaaccccccatgtagtggggcgcggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaa

SEQ ID NO: 20408 - DNA, 1844 bp, Homo sapiens
agccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatgggtagtgctactatggaaggtgaatggacaggcatgagaaatgatcataagaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagc

SEQ ID NO: 20409 - DNA, 2457 bp, Homo sapiens
agccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggag

SEQ ID NO: 20410 - DNA, 2869 bp, Homo sapiens
agtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttg

SEQ ID NO: 20411 - DNA, 1554 bp, Homo sapiens
agcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagggctctggtaacttcgttaacgccaatggcaagctgcttcctgacgtgtgcaggcgtccaccctga

SEQ ID NO: 20412 - DNA, 1613 bp, Homo sapiens
ggtctcccgttcgggggtggctcccaggactgggggttcttcggccgctccgccccgcgatggcttctccgtggcgcggagcccatgaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactc

SEQ ID NO: 20413 - DNA, 1832 bp, Homo sapiens
gaatttgttactgctcacgcctttctgtgggtcatggcttcctctgcttctgagagtgtctcctgatctttcttctcctcttctctaagttcaagttgctctcacctcatctccccagccctctgctcgggaagaccctcattctcctgccccaagctgtggctcctagagaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtggtgagtgagtaaaaacctcttaaattcaactcctgcattcacacattgcttctaagttgattctgagcaccatggataggacacttgttttatcttatagctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaat

SEQ ID NO: 20414 - DNA, 1725 bp, Homo sapiens
atggaacccacagagaatccctgccagggaccgctgggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctag

SEQ ID NO: 20415 - DNA, 2076 bp, Homo sapiens
atggctctccttttgacactaacatcaccagacctggagggtacctgggacaccagagacaaggatggcttcaaagcccaggaggggccgcccctggctgtacctgaatttcctgtgtgtggactgtaccggatctacggagtctgtggctctttcagctccttcttcatcatccggtgcagcctttgtgctctggagaccctcaaatcaccccaacatgatcccttagagatacctgaacagtccctcaaactcatacccctggtgtctgggaaaagggaactcacaaggggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtaaagggggccggctcactggtggcagggtggagtggcggagggcccaccattgaaacactcgaattgcagagtgagcgctcagcggtagcctgggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctag

SEQ ID NO: 20416 - DNA, 1892 bp, Homo sapiens
aaaccggtgccaacgtgcgcggacgccgccgccgccgccgccgctggagtccgccgggcagagccggccgcggagcccggagcaggcggagggaagtgcccctagaaccagctcagccagcggcgcttgcacagagcggccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccaccaccctctagcgagggttttcaatgaacttttttttttttttttttttttttttctgggctacagagacctagctttctggttcctgtaatgcactgtttaactgtgtaggaatgtatatgtgtgtgtatatacggtcccagttttaatttacttattaaaaggtcagtattatacgttaaaagttaccggcttctactgtatttttaaaaaaaagtaagcaaaagaaaaaaaaaagaacagagaaaagagagacttattctggttgttgctaataatgttaacctgctatttatattccagtgcccttcgcatggcgaagcaggggggaaaagttatttttttcttgaagtacaaagagacgggggaacttttgtagaggactttttaaaagctattttccattcttcggaaagtgttttggttttccttggacctcgaagaagctatagagttcaatgttattttacagttattgtaaatatagagaacaaatggaatgactaatcattgtaaattaagagtatctgctatttattctttataatatcccgtgtagtaaatgagaaagaagtgcagagcaggatt

SEQ ID NO: 20417 - DNA, 6567 bp, Homo sapiens
ggctcggagggcgggcgcgggcggaatggggactgcagctgcggcagcggcggcggcggcggcggcggcggccggggagggggcgcgtagcccgagccccgccgccgtgtcgctcggcctgggcgtggccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaagaaaaaaaatgtgtttttgtaggcaaaaagaacatttctaaagtctcaaggaatagcttcctaaagtgttgagtaaagaggctaaataaaatgagactagtttaatatagagagaaaaatacctttatggagtaaacgtgtacatgatgatcatgggttgtcagtgatttgtgaactgagagcagcaacaacattattttttaaaaatcttaaatcctctcaatggatggttaacaaatgctcaaagtccattactctttttattggctcttgcaggttttgtgttttatcatcagtgcttttagaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttccgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaaca

SEQ ID NO: 20418 - DNA, 7613 bp, Homo sapiens
gcaaagtgccaggaatgatgcaggcagcctgccagatccttggaatcttctggaatgagagaggttgagctgcagcccaaaggcctgtgaaagtgccaggttgaagggtgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttcttttcctatagaaaagaagaggaagacagagctcttactagagggaggcagagatggcacagcaagagacatgcccccagcatggcaccactgtcccaggacaggcccacccatgggaccaggttatcagggaccctgtggggatggggtggaagctgggaggtgagccttcctccccaggctgggagtaggcgagacgagactggggcctctacatctgagtgccccccaaacccagcggtcatgtcgtgagcaaagaaagaaaccatgttacctctttcagctgagctccgttctgttgtttctgtggggagagtcaaaggaaggtgactgagggtggcccctcgactctattgcccaggccaggaagcggtacgcaggggtcaggaatggattttaagggcaaagttctcagacccaatgggaacacaaactggtcaacttgccttaacgcccaaagaaaaaggatttgggtctttgttggtttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacagttcttcacagctgggatataggacggaaaaggcagacaggagcccttggccccaaggtttccattctagtgaatctttaaatctcagactctcagagcaaacagaaccctctgatactctaactctacctcctcaggaaacggaagcccaaagaggaggggagcttacagcaggccctggactagggattaacacaaaaacaacagcaacaaatctgatttaagcttcacacatgtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaagaaaaaaaatgtgtttttgtaggcaaaaagaacatttctaaagtctcaaggaatagcttcctaaagtgttgagtaaagaggctaaataaaatgagactagtttaatatagagagaaaaatacctttatggagtaaacgtgtacatgatgatcatgggttgtcagtgatttgtgaactgagagcagcaacaacattattttttaaaaatcttaaatcctctcaatggatggttaacaaatgctcaaagtccattactctttttattggctcttgcaggttttgtgttttatcatcagtgcttttagaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttccgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaa

SEQ ID NO: 20419 - DNA, 2797 bp, Homo sapiens
gtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcggacagatgcccaaatccttgcagagaagtgtgtccatgatgggtgtattgaagtttacaccttagagtcacgtaggcattaaggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagt

SEQ ID NO: 20420 - DNA, 1675 bp, Homo sapiens
acccttctcctggctcagcctcccgagtagctgggactacaggcctccgccacgacgcccagctaattttttgtatttttagtagagacggggtttcactgtgttagccaggatggtctcgatctcctgaccttgtgatccacccgcctcggcctcccgaagtgctgggattacaggcgtgagccaccgcgcccggcttgttgtagtttattaaaacgaggaaactagactatgggatcacaagcccagagccccatgtagctgactctagcgccaagggcggaagagaaacgcccagcgccagggctctccttcgatctctgcagcggcgcgccgggcttcgcgctccggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtt

SEQ ID NO: 20421 - DNA, 3233 bp, Homo sapiens
gttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaaca

SEQ ID NO: 20422 - DNA, 1531 bp, Homo sapiens
aggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcagtgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaa

SEQ ID NO: 20423 - DNA, 2280 bp, Homo sapiens
gcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaa

SEQ ID NO: 20424 - DNA, 3130 bp, Homo sapiens
gtcatttagccgcgcctaggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaaca

SEQ ID NO: 20425 - DNA, 1412 bp, Homo sapiens
gacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcagtgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctg

SEQ ID NO: 20426 - DNA, 554 bp, Homo sapiens
gcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctctcccggctgtgatagaccttcagttacagagagagggagcagagtgggaccaggtctgagaatagtgaagcaactcattcctttcaggacattccctctgatgtcctattttcaaactgaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtgg

SEQ ID NO: 20427 - DNA, 2094 bp, Homo sapiens
cctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataa

SEQ ID NO: 20428 - DNA, 1954 bp, Homo sapiens
atggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaa

SEQ ID NO: 20429 - DNA, 734 bp, Homo sapiens
agtccgctggctgctgcccggcgtggatggtagggctcgagtgaagatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggac

SEQ ID NO: 20430 - DNA, 1051 bp, Homo sapiens
gcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 20431 - DNA, 646 bp, Homo sapiens
cctggcgactcctcccgttccctcttccgcttgcgctgccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 20432 - DNA, 754 bp, Homo sapiens
caaagggagcttgtttgccagggacactgcaagtaggaagtgtctacaggtcgatgacaggcctaatctctatgacagggtctagactttcctcagggtccaggggcgcacctcagggtgaactggaaaactcgaccgcactttagtgccaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 20433 - DNA, 866 bp, Homo sapiens
gtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 20434 - DNA, 749 bp, Homo sapiens
gccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 20435 - DNA, 826 bp, Homo sapiens
gcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacac

SEQ ID NO: 20436 - DNA, 692 bp, Homo sapiens
ctgtaggcgggggagtcatcaaggcagggcagaggcaggaccagatggccgtttgaggtgctgagcaaagctcccggtttgcgcggagaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 20437 - DNA, 773 bp, Homo sapiens
atctcagggcagtaccactgctgtgcggctgtcagtcagtgctgcaggcgccgagaggaggggcttgtgaccgccccagggaagctgggcatcaccaaagggagcttgtttgccagggacactgcaagtaggaagtgtctacaggtcgatgacaggcctaatctctatgacagggtctagactttcctcagggtccaggggcgcacctcagggtgaactggaaaactcgaccgcactttagtgccaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttca

SEQ ID NO: 20438 - DNA, 1193 bp, Homo sapiens
ggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccg

SEQ ID NO: 20439 - DNA, 1014 bp, Homo sapiens
aggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgatttgggcccaggaacaggca

SEQ ID NO: 20440 - DNA, 1193 bp, Homo sapiens
aggtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgt

SEQ ID NO: 20441 - DNA, 913 bp, Homo sapiens
actggggctccgaatgacccagaatctggggtgggcttaggccccgggccgcgtgttcttgccacgagaacccctagcagcctggccttggaatggctggatgaggtgcattcgttggttcattcagatactgttaagagccagctgtgtgctaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatg

SEQ ID NO: 20442 - DNA, 2004 bp, Homo sapiens
gacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaagcttgtctaattgacttgcctaaaaaatgcagtgactccaaacaacatttgacctgtcttcctcaataaaagtcagtgttctcctgaatcctttatgctgccacatttaggggaaacttttcaggcttcatcattctgacttctcagcagcattcagttattgcttcattctccagaaacactctcttctcttggattttctgatcccacacccttggttttctccttctgtgtgtttttcttcatctcctttatcagcttatgcaaacatttattttcataaattctctattcaagacatactgaaaaatgcaaagatggttaagacatgattgggtcctcaagttgctaattatgaatttgggtggtcagccagctataacgtggcagagatggagaagtgccctaacagaggtataaagtcctgtgggagaacagaggaaagaaggtttcctttggctgggtgaggaggtgaaggagatagggtggaaagtcttttataaaagatatagctggctttggaactaagcctgaaggtcaaatagggtatccatagcaggggtctggggcactagacagtctgttcattttcaggaatatatgggtcagttttgtatgtgtgacctaagaaacctgtgacacttcttacaggtcttgacttttctttctcagtacatgtgtatttctctttttggtggccttgaaacctttgagttgaaaattgccttcaccatctgccactttcactaatggtagaccaggaaatttggacccactgaacatagagaacaactagaaaagctgtgcaaaatataaaca

SEQ ID NO: 20443 - DNA, 1209 bp, Homo sapiens
ggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaagcttgtctaattgacttgcctaaaaaatgcagtgactccaaacaacatttgacctgtcttcctcaataaaagtcagtgttctcctg

SEQ ID NO: 20444 - DNA, 966 bp, Homo sapiens
gacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctc

SEQ ID NO: 20445 - DNA, 757 bp, Homo sapiens
gaaggaccctgcgagggccgcaggctatccagcgtggcgcctggtggccgggccctgtgccggaggacaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccac

SEQ ID NO: 20446 - DNA, 1127 bp, Homo sapiens
gacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctc

SEQ ID NO: 20447 - DNA, 1353 bp, Homo sapiens
agaatctggggtgggcttaggccccgggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaa

SEQ ID NO: 20448 - DNA, 1642 bp, Homo sapiens
ggaagtaaaactgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaa

SEQ ID NO: 20449 - DNA, 1590 bp, Homo sapiens
agaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaa

SEQ ID NO: 20450 - DNA, 2713 bp, Homo sapiens
aatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 20451 - DNA, 2606 bp, Homo sapiens
tcgtttccggcggtcgcgcgctcttttctcgggacgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 20452 - DNA, 1921 bp, Homo sapiens
aacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggta

SEQ ID NO: 20453 - DNA, 855 bp, Homo sapiens
ccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaact

SEQ ID NO: 20454 - DNA, 703 bp, Homo sapiens
ctcccgacatcactgaggaagaaatgaggaaactatttgagaaatatggaaaggcaggcgaagtcttcattcataaggataaaggatttggctttatccgcttggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaac

SEQ ID NO: 20455 - DNA, 622 bp, Homo sapiens
ctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggaaacccgaaccctagcggagattgccaaagtggagctggacaatatgccactccgtggaaagcagctgcgtgtgc

SEQ ID NO: 20456 - DNA, 491 bp, Homo sapiens
gtgggatttcttggaacaatcagcgaaggaagaggctagggcgaagctaggtttggagggtggatggcgcttccgaggccccttgaggccttgtctctgccgccacactgccttctcagcccacccgcggggggccacctttctcaactcgcttcgcttcgggctttccccattttcgttcctgccctgtttctttgtgcaactcatctccgaatcttacccgtgtcaagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccagg

SEQ ID NO: 20457 - DNA, 726 bp, Homo sapiens
gcatatccagagcccgccgctttcgtagtcagatttctagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagat

SEQ ID NO: 20458 - DNA, 2882 bp, Homo sapiens
caggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctccttccgacccccacccccagctcctctccctttccttttccccctccccctttcctttcccgtctcacgcgccaggccgcttgcacatgcgcattaggtacaaagcctcgctctttgtccccatctgtcgttcacacgaactcaagcctttggcattcggcagccaatagaatctaagaaatggcggaaaaatgattccgcctcgggagctaaaccttgattggcagtttagctaaccaatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagcctttt

SEQ ID NO: 20459 - DNA, 4661 bp, Homo sapiens
cttacggcagtctcgcgggatttccccctctcgcgggaattatttgaacgttcgagcggtaaatactccctggggctgtcatagaagactactcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcacc

SEQ ID NO: 20460 - DNA, 1224 bp, Homo sapiens
gttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcgagacagtctcactctttcgcccagactggaatgcagtggcaccatctcaactcactgcaacctccacctcctggattcaagcaattctcctgcctcagcctcctgagtagctgggattacaggcgcacgcgccaccacatctggctaattttttttctgtatttttagtagagacattgtttcgccatgttggccaagctagtcttgaacccctgacctcaggtgatctgccagcatcggcctcccaaagtgctgggattacaggtgtgagtgccatgcccagctggatgattaagttctttatagcattttactcttgtataaattgctgaagtaaaaaatcttagtat

SEQ ID NO: 20461 - DNA, 1394 bp, Homo sapiens
agtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtatcgtacatattgtatgattcaacatttttaaaggcagattgtttttagtaaaatgtagcttttgatagttaataaatttgtcatggttgtctttgattaaaggaaactcaccgccatattcacaaataa

SEQ ID NO: 20462 - DNA, 1409 bp, Homo sapiens
agtagagacgcgccgggtgccagcccctcgccgcaccttaaattgttgacaaagtgctcccactttgtggctggagccgtacgaccttggcgcgggtccccgagtggcgggctggaaaagctggaggccagagccgttcgcggactcgcccgagcccagccagccagtggggagaggcaggacgcggactccgcgtgctttgattgcgcccggcagtcctcggcgtgggctcccggcctcgcagcggcagctgcagctgcagcggcacgcgagagctgtcaaatgcacgttctcggaccccacccggacccgcggaattcgaatctctgggtgggtccgcgcaactgtggagtggccctccaggtgatggtgtgtattgcttgcaaagtttgagaaccactcagttatggagcactcagaggctgcagccggagtccagccctttgggttaagaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaag

SEQ ID NO: 20463 - DNA, 2889 bp, Homo sapiens
cctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataa

SEQ ID NO: 20464 - DNA, 2535 bp, Homo sapiens
gcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgca

SEQ ID NO: 20465 - DNA, 3538 bp, Homo sapiens
tcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaa

SEQ ID NO: 20466 - DNA, 2080 bp, Homo sapiens
cctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctggtggtctcgaattcccgacctcaggtaa

SEQ ID NO: 20467 - DNA, 3303 bp, Homo sapiens
aggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatata

SEQ ID NO: 20468 - DNA, 3217 bp, Homo sapiens
aggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatat

SEQ ID NO: 20469 - DNA, 2619 bp, Homo sapiens
agggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtctt

SEQ ID NO: 20470 - DNA, 2400 bp, Homo sapiens
ggctcgtccccgagtaggggacgggaacgcctgggtcccggggacgtggggcgcagggtctggggcccgaggccacggacgaagcgggaagccggctaggcagcggtctctgtctgggatggacgccgcgccccacgcggacctcccgccccgacttcacccagctctgctgcccgtaactcatatgacaagaacatcaggaaccggactattaccccgaaagggccttcccaagtcgtttcgccgcctgcagtgcccgaccgggggccgcgcgtccccggcaaccacgcccgcccgcgcagctgcagaggccggaaaaggcccgctcgcccgcgctcggcaccacccagcccgcgctccgggcgataccaccctgggcggcccctccaaaggccggagatggtgtcgtccccggcctccgattggtcgggggggcgggggcgtggcctctggagcctggttccgcgcgccggagcgcgctagccgcattgcgagccgaacccgggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 20471 - DNA, 1566 bp, Homo sapiens
caaaggccggagatggtgtcgtccccggcctccgattggtcgggggggcgggggcgtggcctctggagcctggttccgcgcgccggagcgcgctagccgcattgcgagccgaacccgggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctga

SEQ ID NO: 20472 - DNA, 919 bp, Homo sapiens
acttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggcc

SEQ ID NO: 20473 - DNA, 856 bp, Homo sapiens
ggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgg

SEQ ID NO: 20474 - DNA, 1833 bp, Homo sapiens
cctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaa

SEQ ID NO: 20475 - DNA, 11389 bp, Homo sapiens
aaacttcgggcggcggctgaggcggcggccgaggagcggcggactcggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 20476 - DNA, 5041 bp, Homo sapiens
agacatgtgggttctttcaaacatactggacttcctccttaggttttagttgtgttagttaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccagaaacagtgagaagaggaacagagctctgggaaagggacaggcaagtctggaatggaaaagaacacgatgagaattagacactggaaaatatgtatgtgtggttaataaagtgctttaaactgaattgacattaacagtaggtgatcaactttcctatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgcacacacaacccaaagatagaaacaaaaagaggagcagtgtcggggagcttggggcctggtgttccatggagagggagaaaggaacaagcctggccaattcattcaactccttataaaaatgatgaggaggctgaaaaccaagaattttgattgggaacagaatacaagcagctggagcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagagattaaaggtcataggttggtcctcagtataaaatcaactggtaatttattcatttcatttggtaaaaatgtattgactgcctgctatgttctaggcaccatgctatgtatttggaatacagctatacaaagcattgtcacataattgaaatgaaaactttatattatttaagtcacaagaacaagctatttaattatattacttttagtttctcttttaataaagaatagataatgctatcattctagatactaaataagtgttttcttaacataatattactattcactttatcttgtagaagaaataactaaaatacgtctgtcttcactcctgcatttgtttgcattttaagggttaaagacagaaatagaaatgtaaacaactttattttgaaaatatttcaatattgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtatgtgggaggggagattagcatgaggggtgggaatggggagatttgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtatatatatatggcattgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcgtatgtcccaggtggagttcagaaaatattcacttcatttccacaaagggaaatagtgcctagagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgtttattgtctgtcttttccaaattctactgcctcttaccctctccagaatgaaaactagtatctttgtttttgtttactgatgtaacccaaacacctacaaacagtgcccagtatatactaggcccgcaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcgtcttgtatgacacagaaagaaatgtttcttcacagagggaggagaaaaatatcttcaagagagaactaattgaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatatgatatccctatatcattaaagtaaagcctaagcac

SEQ ID NO: 20477 - DNA, 959 bp, Homo sapiens
tcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgaggcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccagcatgttggcctcgaactcctgatctcagacttcttctgggggaaaaaaa

SEQ ID NO: 20478 - DNA, 672 bp, Homo sapiens
atgtggatctgcccaggcggcggcggcggcggcggaggaggaggcgaccgagaagatgcccgccctccgctctgctgtgggcgctgctggcgctctggctgtgctgcgcggcccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccaagagtttggacatcgccgggggcccctcccgtggtgccccgccaaccgccggggttccccgccgtctgctccccgcggcccgggaccccttacacgcctcctcggcaggagggaggccggcagcaagtctcagaaactcctttttcgtagtgccagggtgcagggaggtgggcagttttgcccttcaggttccgcgtttcttggggtcgagcgagagccgacggcgggcctcggaggggctgagcgaaggaatgccagattctggcgtggagagcgggggcagggccgccaagccaaacggcctgcaccgtcgcagccagcctcgcctttgccagggggcggcacatgggccgggtgtgtgggcttggtttggatggggacggggttttgcggcgcgcctgagttttga

SEQ ID NO: 20479 - DNA, 2954 bp, Homo sapiens
tcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgaggcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggtgggtcctggaggtaccagcagggaccagaggggatacttgaccttgctttgtcagtgcctgagtctcagtgcccaggtctgtggggctgtaatgctcctccgagggctcactcctcagttgtccttcctgcctttactgactggatcttgagctttgaggaaacattgtggcctcctaagatgcaagtggtggacagtcatttgcctacattgtactttagtatttgaaagaaatttttttttaattgtatgtggctggaaccaggcacatagatgatggttgtctatcatttgaatgtttccaggacattagc

SEQ ID NO: 20480 - DNA, 8070 bp, Homo sapiens
gcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactc

SEQ ID NO: 20481 - DNA, 7914 bp, Homo sapiens
gcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactc

SEQ ID NO: 20482 - DNA, 6745 bp, Homo sapiens
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggattccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20483 - DNA, 3741 bp, Homo sapiens
tgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20484 - DNA, 6751 bp, Homo sapiens
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgaggcccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtaatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20485 - DNA, 6745 bp, Homo sapiens
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctctctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20486 - DNA, 957 bp, Homo sapiens
gatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatggggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggca

SEQ ID NO: 20487 - DNA, 6742 bp, Homo sapiens
agacgtgaggcttgcagcaggccgaggaggaagaagaggggcagtgggagcagaggaggtggctcctgccccagtgagagctctgagggtccctgcctgaagagggacagggactggggcttggagaaggggctgtggaatgcagcccccttcactgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacacagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20488 - DNA, 6745 bp, Homo sapiens
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 20489 - DNA, 957 bp, Homo sapiens; identical to SEQ ID NO: 20486

SEQ ID NO: 20490 - DNA, 957 bp, Homo sapiens; identical to SEQ ID NO: 20486

SEQ ID NO: 20491 - DNA, 957 bp, Homo sapiens; identical to SEQ ID NO: 20486

SEQ ID NO: 20492 - DNA, 957 bp, Homo sapiens; identical to SEQ ID NO: 20486

SEQ ID NO: 20493 - DNA, 957 bp, Homo sapiens; identical to SEQ ID NO: 20486

SEQ ID NO: 20494 - DNA, 2324 bp, Homo sapiens
ctcccccctccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggagccccagctgcggaggccgacggcacccggccccgagcgcctcgacgccgagccgcgcgcgccttctccgccaggcccggcgggcgggagcgggggcgagggagcaggagcggccagtgcccccgacacccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaa

SEQ ID NO: 20495 - DNA, 996 bp, Homo sapiens
agagggggagcgcagccgagccgggcgcaccagcgggacggcgcagggccaggggcgctgagaggacggggccactgggccgcccgcgctggccgcggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcag

SEQ ID NO: 20496 - DNA, 5048 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagacacagttgccattctgtcacccaggctggagtacagtggcacaatctcggctcactgcaacctctacctcctggattcaacctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatggctcctctgctcccatagtgggtccccagtttccaagtcacctaggccttgggcagtgcctcctcctgggcctgggtctggaagttggcaggaacagacacactccatgtttgtcccacactcactcactttcctaggagcccacttctcatccaacttttcccttctcagttcctctctcgaaagtcttaattctgtgtcagtaagtctttaacacgtagcagtgtccctgagaacacagacaatgaccactaccctgggtgtgatatcacaggaggccagagagaggcaaaggctcaggccaagagccaacgctgtgggaggccggtcggcagccactccctccagggcgcacctgcaggtctgccatccacggccttttctggcaagagaagggcccaggaaggatgctctcataaggcccaggaaggatgctctcataagcaccttggtcatggattagcccctcctggaaaatggtgttgggtttggtctccagctccaatacttattaaggctgttgctgccagtcaaggccacccaggagtctgaaggctgggagctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggcagaaa

SEQ ID NO: 20497 - DNA, 4141 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgcc

SEQ ID NO: 20498 - DNA, 4001 bp, Homo sapiens
tggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgcc

SEQ ID NO: 20499 - DNA, 1393 bp, Homo sapiens
ggaggcgcgagccgcgccaaagtctgcaacggcctcaagtctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaa

SEQ ID NO: 20500 - DNA, 2768 bp, Homo sapiens
gaccggggtcggggcagggggcggggccgagcgggagaccagagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccatcctctgccttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttctttttctgaa

SEQ ID NO: 20501 - DNA, 2612 bp, Homo sapiens
agagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccatcctctgccttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttc

SEQ ID NO: 20502 - DNA, 1545 bp, Homo sapiens
atcccgagtccgagccgccgccgccatgagctgccccgtgcccgcctgctgcgcgctgctgctagtcctggggctctgccgggcgcgtccccggaacgcactgctgctcctcgccgaccgtgcactctctgtctcccacctcacgcagcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctaggtatgcctttgtctgtctccgtcaggaaaggtgtgggagtggatctgggacggggccatgacctgtcagatgctgctccacacccattacctaatgtggctctcatatcatctgggtgaggaagggactgtcactcccactctacagaggaaaagaatgaggctcagagaggtgaagtaagctgctcaggattgcacagctggtaagcactaagctaggattctcgcctggatcctgctgctttcaaaaccattgccttttccccgcctacctccgatgagcttcagaatcacctgggatgcttgttaatatccaaattgcaaatcccagggtgtccgattcagtagatcttggcgggctcaagaatttgcatgtctgacaagttcccaggtgatgccgatactgtgggcctggggacccctctctgagcatccgtgcaccccatcctgccttcctgggggacccaaagcacctcatgaccctgctcattcctaaaaagacctaggacatctagtcccatgttatggatgtgcagac

SEQ ID NO: 20503 - DNA, 1989 bp, Homo sapiens
ccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 20504 - DNA, 1942 bp, Homo sapiens
gagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 20505 - DNA, 925 bp, Homo sapiens
gccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcct

SEQ ID NO: 20506 - DNA, 1123 bp, Homo sapiens
ggctgacttcgctgcccgtcacgggaatgcgggagagggcggcgccggggcgctcgcgtctgcgtggagaccggctggccgcgcgcgggaagccgcggaactgcgccggaaagtcccccggctctggggccccggtgacccagagtaagcctccaagaaggaggaggaggagagaaaggcggctcttcccgtgcccctaccagaggcttcggtgggcccaccttgtgacctccgcggccggcccctcagtggaactgcgtcccacgcggggggcgtcccgaccgtgggggccgcggcccgcgctgaccctggacgtcgccgcgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttctgttgttgcggagacactgcagactccactgtgccgaggttgaactcttttttgttgctcaagttctaggagtccctttcctgaatatatacttgtttgtcatagtttccttttcaaagtagtaaacttttctatttttctacttgcccagtagagactctgattctggaaattctgacaaataatttaataatacacatgttgcttctttccctg

SEQ ID NO: 20507 - DNA, 3399 bp, Homo sapiens
cattacgctgctggctggcagcggccgggccggtcggggctgggccctacgcactttgcgtagcgaggggggttaccaaaggcctagtgcttggcctcgagcaagcctggcctatcccctgtagggggtgggtgaggggcgaggctgaggaagaagagaaggggaattggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggtggcggtggcccagctgtagccccagtgctgctgacccccatgcaacaacgtatctgcaacctgctgggcgaggccaccatcatcagcctgcccagcaccacagagatccaccctgtggccctcggaccctcggccaccgcagccgcagccacggtcaccctgacacagatccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttgtaagtgggtcctgtgattggccttggccttagaccggccacgtgcacagctccctctttaataaacgcttaggggttgcactgtttttgagaagaggaatttgttgggctcctgggacccaaactcatactccccctacttgagctgccttgctaagatccagaagattggttagcagggggtcacgtgtgcatgtgatgggacatgtgttgtcatgaccccgggcttgtgacatgacccagccttggtcttggacaactgtaaggaacaacacaacgggctgtcactgggggccgtcacccagcctgggtctctactgagctgcccaaccccaggtgccatcctttcgagtagggtaatgtcactgatgctggcagttgagcaataatatcttcctcctttgggaggtagtgtgactgaggaggaaaccccacccttttctcctcactgtgcctcagttctcaggggactccaatgactgttgtgctctcccccgaccccaccccaggcacagcgcaggcccttgttaggtagtgtgctgggacgcctccgtaatacatgcagtgtgcagccagtctggctcaggaatgctgtgtatggtggggacggtttggccactctctggttttcaacagcatctctgggcagccctttggtggtttgtccctagagcttttgactcaggtcaagctttggatgctgtaaatttttgagaaagccaactagtgtggaagcttgctgccccactgcagtgggtctgagtgacctgttggctttgtgcggaggcttgcatccagccagttgtatttattctgtgtgtgaacccctcctaggaaggcctccaggaaggctgccctgtggccacacccatcctcctttcctctctgctgactccacatttccaaaattcagtgcaaaaaaagccctgctgagcatcacatgctggactcttcccctgccacaccgctcagtgccttctgttctcttgagactccctctgagtagctgagtgaatccaaagccataattgaccctgaacgtaggaggaggaaaaggcgaagctgacctaagaagtgggaccctggccgggcgaggtggctcaagtctgtaatcccagcgctttgggaggccgaggcgggtggatcacgaggtcaagagatcaagaccatcctggccaacatgatgaaaccccgtctctactaaaaacacaaaaattagctgggcgtggtggcacacgcctgtagtcccagctacccgggaggctgaggcaggagaatcgcttgaacccaggaggcggagattgcagtgagccgagattgcaccgctgcactccagcctggcgacagagcgagactctgtctcaaaaaaaaaacaaagaaaaaaccaaaaaaacaaatgggaccctttggattctatgctcagggaagagcaggcagagccttggagtgctgaaggaggtgctgttccctgttccatctttacactttctcttctgagatgtctgtaaggattttacccagatgccatttgtctgtttcattttcagactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacaca

SEQ ID NO: 20508 - DNA, 1907 bp, Homo sapiens
cggaaagcgttgctgcgtaaatggcgggggcgtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtaaggatttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaattaaaa

SEQ ID NO: 20509 - DNA, 1604 bp, Homo sapiens
gtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtacaggtatatctcacagatattgtggcctcggatccagaccattgcagtcaagtgagtcacacaaactttttggtttccaaatgcatataaaagttacgtttacatgctactttagtttattaagtatgcaatagcattgtgtctaaaaaaaccaatgtgcatatctcaattggagaatactttactgttcaaaaaataataatgaccctttgagcctgcagtgagttacagtcttttagctgttggaaggtctggactcaagtgctgttggccgctgactaatcagggtagttgttgctaaaagtggcagtttctcctaatagatagcagtgaagtgtgctacattaattggctcttcctttcaccaaagatttctgtgtagcatgtgatgctacttgatagcat

SEQ ID NO: 20510 - DNA, 498 bp, Homo sapiens
gggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagattttgagagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagaaaagactccttctcccaa

SEQ ID NO: 20511 - DNA, 6496 bp, Homo sapiens
gtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaa

SEQ ID NO: 20512 - DNA, 1658 bp, Homo sapiens
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaa

SEQ ID NO: 20513 - DNA, 1762 bp, Homo sapiens
atcgggctcaagtttcctctcttggccgaaaggggcaggaggagaggagagccacggggaaaggggagggttggaggaaggactgagaactcaggccgagggcttcagacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaa

SEQ ID NO: 20514 - DNA, 1833 bp, Homo sapiens
atatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtaaagacctcctgtgctaccaaaggaactgactgtggccatagttggcgaggtggagatcacaacacaggaaaagactttccatcttaagggattgatgaatccagcatgagtgaggatggggaggaggcggtctctccttccctcaggggaagctggagggagcccctccaaggaggtagtgcaaacttgctgaccctagcaggtgtagctctaacacctcttttcctttgacacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcg

SEQ ID NO: 20515 - DNA, 1523 bp, Homo sapiens
agacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggggcagtagagatcagctggacctggagggagaaggaagacatcccaaccccagcatagttgcttctaactggaactcttggctgcttgggaaataggggcttgggaagcagtggaagagaagagaggaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactga

SEQ ID NO: 20516 - DNA, 1208 bp, Homo sapiens
ggatggaggcaagggctaggggagatactctttcaaaaggatcatttgtagttcctactaattttgtggtaagtcgaagagaagattccatattaaattgctgtgatgggccatccttgtggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacag

SEQ ID NO: 20517 - DNA, 4783 bp, Homo sapiens
tttccgagtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgt

SEQ ID NO: 20518 - DNA, 4873 bp, Homo sapiens
tttccgagtgcggtagcaggagggggcggggaggtaagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgt

SEQ ID NO: 20519 - DNA, 4873 bp, Homo sapiens; identical to SEQ ID NO: 20518

SEQ ID NO: 20520 - DNA, 2172 bp, Homo sapiens
agcttgagcacggagcatggggtgggagtcccatctcactgcagcctctgcggtgagctcagggtgggggcagctgggcgcctgagtggaactggggttgtgaggtgggagggggctgctcaaggatggaggaagggggctggctgggccgcccaggcagcagcacgggcggggcaccctcctcaggcccctcggagctagcaaggggccacccttccagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaaga

SEQ ID NO: 20521 - DNA, 2853 bp, Homo sapiens
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 20522 - DNA, 2651 bp, Homo sapiens
actttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 20523 - DNA, 979 bp, Homo sapiens
actttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttga

SEQ ID NO: 20524 - DNA, 975 bp, Homo sapiens
atagcgtgcaaacctcgccgcgccagggccaagggacaggttggagctgttgatctgttgcgcaattgctattttccccagagcggctttgtctttggatttagcgtttcagaattgcaattccaaaatgtgacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagca

SEQ ID NO: 20525 - DNA, 2399 bp, Homo sapiens
gctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaa

SEQ ID NO: 20526 - DNA, 3686 bp, Homo sapiens
gggctcggcgctcaggtggctccttcttcgcttctcccgatccccggcggtgccaggcacggtgccggctgccgagggaacgcctttgtgcccggtgctgggaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattcaggaatataggtgaataacaaataaggcagcatagcaaactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgtta

SEQ ID NO: 20527 - DNA, 2247 bp, Homo sapiens
tcagtgtatcaaagggacacctgcacccccatgtttattgcagcaatattcacaatagccttgtagttttagcgcttagaggcatttaaacagcctctctcctccagactacttcactgtagtttattatccctgaccctccacaatgtgattaccaaccgctaggatgagttgcatcttattataaagtagcaaattacaagattgtaacattagactttttaagaaaatccagtcagcttttatactaatccatcttaatttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctaaccttttccgtcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttccctttt

SEQ ID NO: 20528 - DNA, 1463 bp, Homo sapiens
caagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaa

SEQ ID NO: 20529 - DNA, 1838 bp, Homo sapiens
ttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggattttttttttttt

SEQ ID NO: 20530 - DNA, 2532 bp, Homo sapiens
cacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaa

SEQ ID NO: 20531 - DNA, 9214 bp, Homo sapiens
acaatgctttgagccttaccgcatttcagtgggggaaaaaaagttacctaggaggtctgatttttcaaagaaatttgcatacatgcaaatgtgccgcccggcctcctcctcggttctctacgtgcccacgcggtggcccggggggtgcggggcaacctggcaaagttgcccaagtcctccaccgagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgct

SEQ ID NO: 20532 - DNA, 1916 bp, Homo sapiens
ttttttttttacccatgattccatatggtatggaccggactacatgttgccccacatgccactgcaaatgttttctcaattaggtgtcttatctcccgtgagttagcatcagatgaagcttgctgacagcgtaatggcagggaaagcttccgacggctccatcaaatggcagctctgctacgacatctcggccagaacttggtggatggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttt

SEQ ID NO: 20533 - DNA, 9487 bp, Homo sapiens
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgctatggaa

SEQ ID NO: 20534 - DNA, 9325 bp, Homo sapiens
gtacaatccaaagcacgcaaggcaaaaccagagcgaatctgagaaccagccagcccgggttggatcgctttcaaaagagagagtgagagcgagcgagcgagcgagcgagagcgagacagtgagagagggagagagcgcgccttgcaattgcaaaagccttctgatttggagttaaaaaaaaaattctccaagaagcctgcaattggccaacagctttttaaaaaatctcttccgggttttcaacggttccaagtttatttagatattttttaaatgcaaaaaaaaggggacaacaaatgaagcaattcgtctgagcattttaaagtttctcacgtactctttttacattgcaatggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgct

SEQ ID NO: 20535 - DNA, 1828 bp, Homo sapiens
ctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggattttttttttttt

SEQ ID NO: 20536 - DNA, 1274 bp, Homo sapiens
gcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaggtaagaatttcttttcttcaaataaatgcatcaagatatagatgtccttgcattaccaacaatccatagtaaaacaatcattttacaaagccgcataccaaaagtagactgaagtttgagctgtcacagatggtaggtcatttccaaacttggcctggtgggaggaaaaatggcctgcagatagccaggtgacagactgttacctgaggtttgttatataaatgtgggacttaataaactgctatgagctttattattcaaaaaaa

SEQ ID NO: 20537 - DNA, 840 bp, Homo sapiens
atgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttgg

SEQ ID NO: 20538 - DNA, 8159 bp, Homo sapiens
tattgggcagtacaggtctagatgatcaaatgcctacactgaatgacttcatagaatatcactgttgagctgacaccgatctaaaagattcacatgtcggagcaagactgttagtggagtaaactcctcgagtgtacaggacccctttgttcttgttctattttgtttttaacagcttgctctgctccataaagatccatcagtcaccctcaaactcttcggaccttctgcctgttcattcctatgaagctgcgtttgctaaggtactcggtgacctggagcaaacattctaaaacagcgcaaatggcagaagcagagcctacaggcttcttgtcgggaatccgttcggagtatggaaagaatcccagtgtctgtggacttctgggttgtctgctgtgcagttctgaaatgtaaccctgggattcctaaaagaatgtcaactctgtgctttggattttctgatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagactctg

SEQ ID NO: 20539 - DNA, 2381 bp, Homo sapiens
ctgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaa

SEQ ID NO: 20540 - DNA, 8198 bp, Homo sapiens
gcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 20541 - DNA, 2869 bp, Homo sapiens
ccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaa

SEQ ID NO: 20542 - DNA, 3129 bp, Homo sapiens
tcgagcggggtccagagggtggaaccggtgaatttttcaacttccaagttttgcaacgaaagaaagcaagagagggagggaaaaaaaagagcctagagcagaaaagagaggagtttggagccgagcgggagagcgggatttatcgtttggaatttttcaggagatcgttttgatacccctgggctctgggcagcggcggcaacagcagcctccacgctcggccgggtcagacgcggggcgaggcgggcgggcgggcggccgggcgccgaagacccggcgcgggcggcggcggctgctgctgccggggaccacgcgccgcgagcctcttccgccccagagatcagcgctcgcgccccctccctcaccccggcctctcccttctcccccatcccaccccgcccccaccccggccctctcccgcgcgcgccccgccacccgcgcgcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaa

SEQ ID NO: 20543 - DNA, 3318 bp, Homo sapiens
aagcaagagagggagggaaaaaaaagagcctagagcagaaaagagaggagtttggagccgagcgggagagcgggatttatcgtttggaatttttcaggagatcgttttgatacccctgggctctgggcagcggcggcaacagcagcctccacgctcggccgggtcagacgcggggcgaggcgggcgggcgggcggccgggcgccgaagacccggcgcgggcggcggcggctgctgctgccggggaccacgcgccgcgagcctcttccgccccagagatcagcgctcgcgccccctccctcaccccggcctctcccttctcccccatcccaccccgcccccaccccggccctctcccgcgcgcgccccgccacccgcgcgcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccacctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaa

SEQ ID NO: 20544 - DNA, 1855 bp, Homo sapiens
acagccatgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatctt

SEQ ID NO: 20545 - DNA, 2363 bp, Homo sapiens
atgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 20546 - DNA, 2185 bp, Homo sapiens
aatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 20547 - DNA, 1586 bp, Homo sapiens
aatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggggggatggg

SEQ ID NO: 20548 - DNA, 2175 bp, Homo sapiens
ccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 20549 - DNA, 2247 bp, Homo sapiens
ccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 20550 - DNA, 2401 bp, Homo sapiens
ccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 20551 - DNA, 8068 bp, Homo sapiens
gctcgctccctcccccgcgcgccctccctcgccgcctcctcccgccgcctgcggcccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 20552 - DNA, 1727 bp, Homo sapiens
cagacggacactgtgccggggcgagctgacaggagttcacggctgcgatagaacatggagatgtcatgggcgcgacagagcctggcggggataccagcagcgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccgcccccgtcactgcgcttctgttataccatctttgcctgactctctccggcttctccattgaatggctaatgtgtatgtg

SEQ ID NO: 20553 - DNA, 5530 bp, Homo sapiens
atgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 20554 - DNA, 5576 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 20555 - DNA, 5724 bp, Homo sapiens
gcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 20556 - DNA, 1688 bp, Homo sapiens
agacggacactgtgccggggcgagctgacaggagttcacggctgcgatagaacatggagatgtcatgggcgcgacagagcctggcggggataccagcagcgtgtgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccg

SEQ ID NO: 20557 - DNA, 1188 bp, Homo sapiens
ccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaacc

SEQ ID NO: 20558 - DNA, 2203 bp, Homo sapiens
ccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacgcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaacc

SEQ ID NO: 20559 - DNA, 2272 bp, Homo sapiens
ctccagaactcccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccag

SEQ ID NO: 20560 - DNA, 2058 bp, Homo sapiens
gtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaaacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatatt

SEQ ID NO: 20561 - DNA, 3923 bp, Homo sapiens
gtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaata

SEQ ID NO: 20562 - DNA, 3787 bp, Homo sapiens
ctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaata

SEQ ID NO: 20563 - DNA, 1338 bp, Homo sapiens
tcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttcgggatgttgcctaaaaccgtcgacaaacgctatgtttgagaagggaggctacgctggggcgccggaggagacaggcccttaagaaccttccagagatgccttaactgggctaacagctcgccgcgccggggcaggcagaggggtgcggggcgcgctccttccaggacttgccagtccccaagaaccaggccaaccggttccctccactgactcccgcctccctctgcaggcccagccctgcgccgcgcgccctctccccgggcgcccaggcccggcgggggcctagagggcagggatggcccgggcgagggacggggtcccggaggcgggaggcgggaggcgggaggcgggaagcgggaggctggaagccgcgcgctgtcggggtttcccggtgaagggcaggcaaacaaccggtcggtctgggcggagccgggcgggcggggcgagggcggagggcggagggcgcattgcctcatcctgtacattttactggaaatcggacgcatccggaggaggggctgggaggcggcccgggcaccgccaatggccgggccgggcgccggggaggtcggcgagcgctgcggcccgttaaataccctggcagtcccgcgccgcgcccgtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccct

SEQ ID NO: 20564 - DNA, 2006 bp, Homo sapiens
ctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacag

SEQ ID NO: 20565 - DNA, 564 bp, Homo sapiens
gatgtaggtgtaattttcttcttgtgaatattttagtggaaagctgtagcagaggataagggtttgggaatagcgttaaaggtcatgacttatttctcagtttttatggaatttttcagtaaaaagacttgaccgtcaaagaaaaggaaactgctgttatcaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgt

SEQ ID NO: 20566 - DNA, 1401 bp, Homo sapiens
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20567 - DNA, 1411 bp, Homo sapiens
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20568 - DNA, 1478 bp, Homo sapiens
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20569 - DNA, 1401 bp, Homo sapiens
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20570 - DNA, 1411 bp, Homo sapiens
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20571 - DNA, 1478 bp, Homo sapiens
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20572 - DNA, 1401 bp, Homo sapiens; identical to SEQ ID NO: 20569

SEQ ID NO: 20573 - DNA, 1478 bp, Homo sapiens; identical to SEQ ID NO: 20571

SEQ ID NO: 20574 - DNA, 1401 bp, Homo sapiens; identical to SEQ ID NO: 20569

SEQ ID NO: 20575 - DNA, 1401 bp, Homo sapiens
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20576 - DNA, 1478 bp, Homo sapiens; identical to SEQ ID NO: 20571

SEQ ID NO: 20577 - DNA, 1411 bp, Homo sapiens; identical to SEQ ID NO: 20570

SEQ ID NO: 20578 - DNA, 1401 bp, Homo sapiens; identical to SEQ ID NO: 20569

SEQ ID NO: 20579 - DNA, 1411 bp, Homo sapiens
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20580 - DNA, 1478 bp, Homo sapiens; identical to SEQ ID NO: 20571

SEQ ID NO: 20581 - DNA, 1411 bp, Homo sapiens; identical to SEQ ID NO: 20570

SEQ ID NO: 20582 - DNA, 1478 bp, Homo sapiens
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 20583 - DNA, 1401 bp, Homo sapiens; identical to SEQ ID NO: 20569

SEQ ID NO: 20584 - DNA, 1411 bp, Homo sapiens; identical to SEQ ID NO: 20570

SEQ ID NO: 20585 - DNA, 1478 bp, Homo sapiens; identical to SEQ ID NO: 20571

SEQ ID NO: 20586 - DNA, 1411 bp, Homo sapiens; identical to SEQ ID NO: 20570

SEQ ID NO: 20587 - DNA, 1260 bp, Homo sapiens
agaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggttttgagcccagttctctacaggagaatcccaggagtggaagtggaaggcagtag

SEQ ID NO: 20588 - DNA, 1260 bp, Homo sapiens
agaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggttttgagcccagttctctacaggagaatcccaggagtggaagtggaaggcagtag

SEQ ID NO: 20589 - DNA, 1260 bp, Homo sapiens; identical to SEQ ID NO: 20588

SEQ ID NO: 20590 - DNA, 1260 bp, Homo sapiens; identical to SEQ ID NO: 20588

SEQ ID NO: 20591 - DNA, 1260 bp, Homo sapiens; identical to SEQ ID NO: 20588

SEQ ID NO: 20592 - DNA, 1260 bp, Homo sapiens
agaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggttttgagcccagttctctacaggagaatcccaggagtggaagtggaaggcagtag

SEQ ID NO: 20593 - DNA, 1260 bp, Homo sapiens; identical to SEQ ID NO: 20588

SEQ ID NO: 20594 - DNA, 5009 bp, Homo sapiens
gctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagccc

SEQ ID NO: 20595 - DNA, 4949 bp, Homo sapiens
caggattccagaattggaaataacgggagggaggacctggtccagcttcccttcctcaaataaggaaattgacacctggcgtgagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacaca

SEQ ID NO: 20596 - DNA, 4114 bp, Homo sapiens
caggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttcc

SEQ ID NO: 20597 - DNA, 4351 bp, Homo sapiens
gctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcag

SEQ ID NO: 20598 - DNA, 2081 bp, Homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacac

SEQ ID NO: 20599 - DNA, 2267 bp, Homo sapiens
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgtagtttaggtatttgggaacttatttcctttttgaaaatgctaacttgttgaaagaaagaactgtggccatgcctcatctgtgcttgtatgccctaaatgcttagcatatttccttgtacataatttgtaataaacatttatccagtgaataactggttttttttttattcatgtattgcagataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaa

SEQ ID NO: 20600 - DNA, 3492 bp, Homo sapiens
aatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacagctggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcaagaaaagtatgacaaacacatgtctgaacatacaaaatgccctgaattagattgctcttttactgcacacgagaagattgtccagttccattggagaaatatgcatgctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacacagtttgtacttttattactagttagcatacacattttataggcttatgggttaataaatgaattcatggactcctggactactttcattgatgaccatatctccagggatgttgttgatccccacactgccttaaggtatattatagaaacagttttattttccatttttcttgtttcctgataataaatgtatttaggactgaaaatactcctgagtactcccttggctgtatgtctgacagtctttagctatggtgactattgtttatttttaatgggtatttcagattccaagtgtatttaaaatttctaaggagatataatatagcctgtatggtttctactttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactatt

SEQ ID NO: 20601 - DNA, 10879 bp, Homo sapiens
agatatactgagtgagccctgagaagcagtctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacccatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatcccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttctg

SEQ ID NO: 20602 - DNA, 3775 bp, Homo sapiens
gtgctggagaggccgctgcgagcggaaggcctcctccataaccgagtccgaaagggcagaatctatgggggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 20603 - DNA, 7227 bp, Homo sapiens
gcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 20604 - DNA, 7140 bp, Homo sapiens
gcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 20605 - DNA, 539 bp, Homo sapiens
agagcgggagcgcgcagccaggctggagtccagtggtgcaatctcggctccctgcaacctctgcctcctgggttcaagcgattctcctgcctcagcctcctgagtagctgggattacaggcatgcaccaccatgcccagctaattttgtatttttaatagaaatggggtttcaccatgttggtcaggctgatcttgaactgccaacctcaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccct

SEQ ID NO: 20606 - DNA, 583 bp, Homo sapiens
aattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagacagggtctctctctgtcacccagactggagtgcaatggcgggatctcagctcactgcaacctccacctctcgggttcaagcgattctcctgcctcagcctccctagtagctatgattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcag

SEQ ID NO: 20607 - DNA, 7343 bp, Homo sapiens
aagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 20608 - DNA, 606 bp, Homo sapiens
tcttcctgctctgccactgactcaccccgttgacctggcctgcatggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagct

SEQ ID NO: 20609 - DNA, 582 bp, Homo sapiens
agccaggtaaccggcgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggaggaaactgcagctgaggagccattgcagtcccatctccagaagacccccagaaagagttggaagagttcttcaggctgtggcagccactgcccaccaacacacccaaatcaatcaagatgaatcccaggtggtgaggctgaagcagatggtttggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactg

SEQ ID NO: 20610 - DNA, 582 bp, Homo sapiens
agtgactcttcctgctctgccactgactcaccccgttgacctggcctgcatggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagag

SEQ ID NO: 20611 - DNA, 576 bp, Homo sapiens
agatgtcagcatgtttttgttcagagaaggaaagcgtgtttgcctgcacgttgagctgtagagacagctcaggagagggcttcaccatttctgcgtgaggccgtgggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggac

SEQ ID NO: 20612 - DNA, 7194 bp, Homo sapiens
gcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagacataaagcactcatgacaattatacctgatttgtcccccaacaaccctctgagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 20613 - DNA, 2331 bp, Homo sapiens
cgggagcgcgcagccaggtaaccggcgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaa

SEQ ID NO: 20614 - DNA, 582 bp, Homo sapiens
ggatttagtgggtggccgtgtcccagagcagggcaggcggtgcccatggaaggtggcagggcgctttgtgtgcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctg

SEQ ID NO: 20615 - DNA, 589 bp, Homo sapiens
atagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagctgtggcagaagcagtgtgaacaatgaatgcagaaatgctttgtatacatgaagacctatactgatgagaaagatagaggatgtagctgagatgtgctggagagagcactggatttagaagacatctctttgagttctggctctgcagccttaccagtcgaccttgaggcaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaa

SEQ ID NO: 20616 - DNA, 583 bp, Homo sapiens
gtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatc

SEQ ID NO: 20617 - DNA, 2766 bp, Homo sapiens
gcacttctggctgtcagccaggaagatcgctcctgccaggcagactgagaagaaaaccaacaacttttcttttgtgtgtggggttactttccactggcccccccttcctcctctcctttcaagatttaaatgctaatggcggattaaaacctgtagatacgtttggctttaggagtctggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggc

SEQ ID NO: 20618 - DNA, 874 bp, Homo sapiens
ttttgttttcagccatgtaggagaagcagagtctacaagtccccgtgcctgcgtctgttaagggctgcagccagtgcctggcgtactcggtctcgtgccttggcccctcagcccctccccataaatgctcagcggaacaggggattaggttctggcagcacagctgggattttggcggccattccacagccgacaatagcacgcagcacaggacagcgcaggcctgtactccagggccagaatctgcctgggcttcttgtttgggtggcggagggggaggagcgggcacagcacggcatcctggccttgccacgcagaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccag

SEQ ID NO: 20619 - DNA, 911 bp, Homo sapiens
aattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctcca

SEQ ID NO: 20620 - DNA, 600 bp, Homo sapiens
ggatgtgagtgtctctcagatggggagtatctttctaagaaaggggtacagagcatggaattcttaggctacaggcaggcagcgtctcagggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacc

SEQ ID NO: 20621 - DNA, 792 bp, Homo sapiens
gagagatggacagattattactgctgccttaaactctgggtggaaaacagagcgaagggggagtgtccggttgatcccagtttgtcaggcaggccactgcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaa

SEQ ID NO: 20622 - DNA, 280 bp, Homo sapiens
gcgctcacagcgctggcgcgagcccacgaagaggtacgattccggagaatcgcgaggcagagcgggagcgcgcagccaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccgg

SEQ ID NO: 20623 - DNA, 1084 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 20624 - DNA, 1102 bp, Homo sapiens
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtcctta

SEQ ID NO: 20625 - DNA, 2112 bp, Homo sapiens
gcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaacacgcctacgaaaa

SEQ ID NO: 20626 - DNA, 1003 bp, Homo sapiens
agtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaaggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaa

SEQ ID NO: 20627 - DNA, 3212 bp, Homo sapiens
atcgggccgtctcaggtgggccggcctgggcgggcggggtcgaggctgcgctcggtgccctgtcgcgcggagggaaattgctctgcgccccacttcctcccctgaggaatgagatccgaatcccgggagcccggtctgggccgtcagggactctatcgacccgggcgcggggcctcagacactgaggcccgcttcttaccaacaaggaaactgaggccagggagggcggcgccccccaacccgctcctgtgccccatggtgtccgggcgggctgcgtgggagggtcccgtggtcgcgggctcgcgccggcctgcccaacccagaggaggcagcagaggcggctcccacacatccctaaccctaacccgacccctgggtcgcagctggagggcggcggggcccgggccggggcctcttccccttcccctgcgcaggacgccttgtcaggcctcaggacccccaagccacagcctttgcatctgcataaacgggtgcggtggggaccccacctcatttgagggcagtaggggcggcccgctagacgccccgcagtggctcctcagtagagctgtccttaacgtcgccctggtgggccggacagctacccttgaacccgggaggctgcaggcgcccttttctgggtgcacctgcctgtccatgtccaacagccccgcggggccagagctgagcagggcgagaggcgggctgctgggagcgcttccggcagggatgagctgggaggcggctttctgggctgccagggttctcaaggagaagagagagaaatccacttgtttcccgggcactgagcaggaggtggtctccaaacagatccaagcacacgtcctctcgatgggcagtgcaactctggtctctgtggtggtcacgccccctgttcacgtgaagggtgaaggtcagtgttggtggtgtctccgcaggtgggtagtttgcaggcgctgttagcactggccttcctgcacactgggaacttcagtgccgcaggatgttgggaacccgatccctgggtgagagcagtggggcaggaagaagacggtgggaccagcctcagtccctgagtgcatggctcctggcagagccttcaggctgtgcggctgggcagccatccttgaggcctggcctcccagggaacctccgcccactcacaggggctgatttggggtctcttcctgctctaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaac

SEQ ID NO: 20628 - DNA, 6117 bp, Homo sapiens
gttcagtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaagttcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttactttc

SEQ ID NO: 20629 - DNA, 7688 bp, Homo sapiens
cctccgcctcccctcaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaa

SEQ ID NO: 20630 - DNA, 12195 bp, Homo sapiens
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactc

SEQ ID NO: 20631 - DNA, 1849 bp, Homo sapiens
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaacacccccg

SEQ ID NO: 20632 - DNA, 12533 bp, Homo sapiens
atggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactc

SEQ ID NO: 20633 - DNA, 12892 bp, Homo sapiens
gctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcatata

SEQ ID NO: 20634 - DNA, 585 bp, Homo sapiens
acaagcccgacttcacccgccctgaaccccgaagagttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtg

SEQ ID NO: 20635 - DNA, 533 bp, Homo sapiens
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaag

SEQ ID NO: 20636 - DNA, 6952 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 20637 - DNA, 6895 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 20638 - DNA, 6828 bp, Homo sapiens
ggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 20639 - DNA, 7405 bp, Homo sapiens
gaatctcgcctgccgggaccgcgaaatgggggcgaccgcggcgtccctctccgtcggcgcagccctcgacggcgcttgggtttgaccccggcgcgcttgctcgccccttctcccgagaaggggtttcggaggagcagaggtttaataggcaagagaaagagaaaggaaaacagctctctctctaatgagagagaggggacttcggagaggaaaagaggacaggagatacggcaatcgtggataggaaaggaggaaattacgatagaaaagttggagatccttttgctaacacccctttgggcagttggatgctgagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 20640 - DNA, 7289 bp, Homo sapiens
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 20641 - DNA, 4597 bp, Homo sapiens
caacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactc

SEQ ID NO: 20642 - DNA, 1760 bp, Homo sapiens
ctggatcagttgacaagcaagccatcatcaatgacctcatgcaactcacagctgaaaacagccctgtcacacctgttggagcccagaaaacagcactgcgaatttcacagagcagaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtct

SEQ ID NO: 20643 - DNA, 8447 bp, Homo sapiens
agttattaacacgggaacatggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggttttacatggctttagagattttaa

SEQ ID NO: 20644 - DNA, 438 bp, Homo sapiens
agagcaagcaatagaatagaagcaggaagaattttcgagtgttccaccatgctggattgtcaaagggggatctgtctgatcagcagctaaaaaaggatttgtgtggctagtttgtcagctatcgttagaaacaaatgatagaggagataagcggcggggtgctcagcatgtgcttaggtttacatcaagatgtaatgttggtttgggttaacagaggagatttatctctgaggcaataaatttattgctaattgtgggggtttttgttttgatgagtgatgtatggtatttgtatttacatcactggtgaagataaagagaagctgctgagctctaatatgaactgcagaagctgtggacagttacaagttgctgatatgtgttcaagatgagtgggatgggagaaaatacctctgacccctccagggcagagacaag

SEQ ID NO: 20645 - DNA, 526 bp, Homo sapiens
ggagggggccggggtcgtcgctgccggctgcgctccccgcctcctcccctcgggggagtcccagaggcgcctcttccgagaccgggggtgggtcggtccctggttagatggcccctccctcttcccctccctctagtggtttccggggcctgcgggaccgaggggcgggaatcggggactggagcccccttccgctggcccggagctggactgggcctcccgcgttctgggtccgtcactggtaggggaaactttcccaaaccagagaccgagcctgaacaccttcctccgccacctcgtcctctaatcccactccctctccacctcctccgacgccttcccctcccaccgacccgaatctcggtgcgtctgactgatggggcagtgagccaatcgaaggcagggagctgacctgccgggtgtcgatttctcttggatttggctacacacttatagatcttctgcactgtttacaggcacagttgctgatatgtgttcaagatgagtgggatgggagaaaatacct

SEQ ID NO: 20646 - DNA, 7984 bp, Homo sapiens
atatcccagtggcccccgtgcggcgactttagctgctgctgtctcagccgctccacagcgacggcagcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattgga

SEQ ID NO: 20647 - DNA, 7774 bp, Homo sapiens
atatcccagtggcccccgtgcggcgactttagctgctgctgtctcagccgctccacagcgacggcagcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattgga

SEQ ID NO: 20648 - DNA, 6750 bp, Homo sapiens
gtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttat

SEQ ID NO: 20649 - DNA, 4668 bp, Homo sapiens
ctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccaggtgagctcccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctc

SEQ ID NO: 20650 - DNA, 6851 bp, Homo sapiens
agccgctccacagcgacggcagcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaa

SEQ ID NO: 20651 - DNA, 1016 bp, Homo sapiens
ctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgattctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatca

SEQ ID NO: 20652 - DNA, 945 bp, Homo sapiens
ggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagcaggaagtattacttaattcacctctacaggaggaacataacttccccccagaccattatggcctccctgcagtttgtgatctctttgcctgtatgcagcttaaagttgataaagagaagtggttatatcgaactcctctacaggtg

SEQ ID NO: 20653 - DNA, 3487 bp, Homo sapiens
ctggagttgccgtgtgacgcgtgggcgggacgaggcccgggctcggggacctttcgcactcgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 20654 - DNA, 3293 bp, Homo sapiens
cgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 20655 - DNA, 3431 bp, Homo sapiens
ggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 20656 - DNA, 1755 bp, Homo sapiens
tagtgtggggccgtgtctcagtccacccaaggtctcctcggatcgcctggagaggcactcggacctgactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagt

SEQ ID NO: 20657 - DNA, 2124 bp, Homo sapiens
aactctgcctttgggccgtaggttagtgtggggccgtgtctcagtccacccaaggtctcctcggatcgcctggagaggcactcggacctggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctc

SEQ ID NO: 20658 - DNA, 792 bp, Homo sapiens
ctgcactccagcctgggcggcagagctagactccgtctcaaaacaaaaaaaaaacccaaaaccaacctttaaaaaaaagacggaagaaagaacgtgtgaagtgaaaaaagtctcaagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaa

SEQ ID NO: 20659 - DNA, 3646 bp, Homo sapiens
agagggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcc

SEQ ID NO: 20660 - DNA, 3575 bp, Homo sapiens
attgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcc

SEQ ID NO: 20661 - DNA, 3735 bp, Homo sapiens
agagggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacaggcatacttcaaaatgaactttcaagatgtaaccgttgggaattttcagatcccatgtggattctagtagtttatatacctacctcgaagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcc

SEQ ID NO: 20662 - DNA, 7081 bp, Homo sapiens
ccccctccccgccggctccgtgaggccctgccgggtcgggctgcgggcggccgggcgcgggcggcgggacagacgggcgcacgcgaggactgacggacggacgcaccgagggcggcgggcacgcacggcccgggccggcgctccaaggcccgcccgggagggccggggccgcgctcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 20663 - DNA, 9311 bp, Homo sapiens
ctccagcccaggcaacagagcgtgactccgtctcaaaaaaaaaaaaaaaagtgaaaggaaaatgaggggagaattctcattgataataagggcgaaaaggtttttttggcagagtaatagagttttggaaaccattgcaaagctgtcaagtgtggtgtagtttttggttaaggaaatcagaggtgtcagcagacataaaagacaggggaaaacatgggaagtgtcctacctatagtgtagaaaaagcacaactatctatgtcagaggtcgacagactgtggtccataggtcaaatctggcccacgatctgtttttgtaaataacgttttattggaacatagccacactcatttatttatatattgtccatatcttcttttgtggtaccaatagcagagttgagtagtcgtgacagagatgtgttgtgtcagctcacaaagctggaaatactctttacaaaaacatttgccaacccctgatctatgtgtttgagtgttggatgttcaacctctaatttgccatccaatgtctatatgatgatagagaatgaataaacgtcttggctctgccctttgggctggattacccatgctctgtgtacctgcagcataacacagacccctgaatatttatatcagtcagtgatggcaaggtctattgttctggagtgtactgtgtggtaactgtggtagtgccagctttacacggattagataatgctcgggcttgttttgccattttttttattgggttgtcttttacaaaagatttatttatatattctgattattaatcctttgttgttggtagatattacagatgtcatttcccagtttcttgcttattttaatttttttttttttttttttgagatgaagtcttgctctgtcgcccaggctggagtgcagtcgtgccatctcagctcattgtaacctccgtctcccaggttcaagtgattctcttgcctcagcctcccaagtagctgggactacaggcatgtgccaccacacctggctgatttttgtgtttttagtagggatggggtttcatcatgttggccaggctggtctcaaactcctgacctcaagtgatccacccgtcttggcctcctaaagtgctgggattacaggtgtgagccactgcgcctggcctgttgcttattttaaaacatctgttttaaggtgtcatttgttaaaaagttctgaattttagtatcaactttatcaatcttttcctttaagatttgcagttattctttgttttgaggcagggtctcgctctgtcaccgaggctggagtgcagtggtgcgatctcggctcactgcagcctcaacctcctgggctcaagcaaccctcccacctcccatgccagttgagaccacaggcatgcgccaccatgccctgctactttttgcattttttgtagaggcggggtttcgccatgttgcccaggctagtctggaactcctgagctcaagcagtccacaaagtgctgggattacaggtgtgagctactgtgcccagcctgcaattattctttatattctggaatacctactgttgttttcaatggttagatctttaatgtatctggaatggattcttatgtgtagtgtaaggtcgggtccagtttcattttttttccctatgtataaccagtgatcccagcatcatttattgaatggggcttgctttcaaattgtgagctctttttggtggagtctgtctcaggtccttattaagcactgctgcttgctgattgtgtgaccttggacaaataaaacctcattgcgcctcagtctttaaggataatagtaatctcatagggttttgtgaggattaaatgagtcaatatacataacgtgtaaaacagtgcttggcacctagaacatgctcaataaatattagctgtactttagcactactgttcatttctgattcctcagcacctggtacagagcaggggctcattttgctcaattaaattgccaaattaatttggttttcaggtcaatcagaatggtgagagttgggctgagtgttgcaggagatgcttccaaggagctacttagttttaggggctgccttagattatctgctaggatagaactcttctcacgccatcacttttgcagagaacttctgtagcagaggttgcaaactggcaacctgtggttggatttgacctgtataagtattttgtttggtttacacaatatttttaatgtcttaaaaatgtacacagacctctgagtttctgacttaaccttgaaaaattggaagatctgtcaacagcaagcccatattcatttatagcggtaaccagctgaaacttttaggtcctgggaggaatggagaggggtcccactgactaacttttctgagagtggtcagagagttcttaagcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 20664 - DNA, 6933 bp, Homo sapiens
gtgaggccctgccgggtcgggctgcgggcggccgggcgcgggcggcgggacagacgggcgcacgcgaggactgacggacggacgcaccgagggcggcgggcacgcacggcccgggccggcgctccaaggcccgcccgggagggccggggccgcgctcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 20665 - DNA, 2998 bp, Homo sapiens
gatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacag

SEQ ID NO: 20666 - DNA, 3108 bp, Homo sapiens
atgggtgctgcacacagtgtttgggaggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtgattttctttc

SEQ ID NO: 20667 - DNA, 5521 bp, Homo sapiens
agaaaccctcataaagtagatgcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattagttgcaggatggctactcgtatccctccacacatgatcatcagtatttgcctcctgtgtcccaaccggcctgagtcaaggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 20668 - DNA, 5455 bp, Homo sapiens
cgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtgattttctttc

SEQ ID NO: 20669 - DNA, 1321 bp, Homo sapiens
gatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaag

SEQ ID NO: 20670 - DNA, 765 bp, Homo sapiens
gacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcct

SEQ ID NO: 20671 - DNA, 488 bp, Homo sapiens
actccattttatttttcacattggccagtgtaaacttttaagtttacagttgctttgttatcttttcttacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacact

SEQ ID NO: 20672 - DNA, 548 bp, Homo sapiens
agaatttgcaagttaagacacatgtacctagccactgggacagggaggtcattgaggacctccagctgtgtgacccacagctgtgtgggtcagtttggtgtagttaaggggtctctgctggttctgttcttttaaatggtgccatgtgtacaaacaaggaacacttttctgatgattcaaaaaatactttgtcttcatcacagctcttttgagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattg

SEQ ID NO: 20673 - DNA, 2271 bp, Homo sapiens
gcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattagttgcaggatggctactcgtatccctccacacatgatcatcagtatttgcctcctgtgtcccaaccggcctgagtcaaggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttc

SEQ ID NO: 20674 - DNA, 636 bp, Homo sapiens
tgctttctggtggcggagcaagcttggagacaagtagctttggagaatagctgagggtccatttccactgcagactaatccctgccaatgggtgctgcacacagtgtttgggaggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaag

SEQ ID NO: 20675 - DNA, 3052 bp, Homo sapiens
agagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 20676 - DNA, 2978 bp, Homo sapiens
agagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 20677 - DNA, 567 bp, Homo sapiens
agagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaagtggagtggagaaaattcatactttatcaatggagacataagttctttagaacttggtggtggagg

SEQ ID NO: 20678 - DNA, 581 bp, Homo sapiens
gacccctccttccacccgccgagaggatgcgctccccggcgcccagcagcagaggccaccgctcccagaaatgcatgcgaccgatccccttctcccggaccccaggagccggcgcccccgccctgtagattcccactctgtcgcccaggctggagtgcagtgatgtaatctcggctcactgcaacctccacttcccaggttcaagtgattctcctgcctcagcctccagagtagctgggattacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattg

SEQ ID NO: 20679 - DNA, 8708 bp, Homo sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatcgtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 20680 - DNA, 8522 bp, Homo sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 20681 - DNA, 8660 bp, Homo sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 20682 - DNA, 8520 bp, Homo sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 20683 - DNA, 8533 bp, Homo sapiens
catgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 20684 - DNA, 8475 bp, Homo sapiens
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggt

SEQ ID NO: 20685 - DNA, 8529 bp, Homo sapiens
catgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccacggaggacatcccggcccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 20686 - DNA, 2807 bp, Homo sapiens
ttacagtcaggagccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 20687 - DNA, 3809 bp, Homo sapiens
gcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaacacttcagaagcataactacagcctgcagcatgtctgcacgtgtgcatgcatacacaccgggttgacagatagagaaaactgggtttgaaccaaatgccgtagtgacttgctgtggaccaagtccttccatctaatagaagctccaggggctccttcccattcagacctctctagactatagtctatgcttagagatcttgtctggttatggccattgttttttactactttgatcacttaacttatagaccttttttgacactgccagtctcacttgtggcctatttctctgcttcttccaggaatttgcttttattagtcaagtataggggctgccaggttctgtgtctccatagatatatgtgcttcttttcctatagctaaatgtataataaacaggaacctgacctttacctcctttcagctgtttcaaacaggtgccaggatacctatgtcttagaattagagtttcttcaaattgattcattgatttctcaagtatggattatgtgaaagagcccagggacattatccattacagtttaactctttcatttaaaggtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtcagacgttgattactcccaagatccgatcagcatttctgcccatcctattatgtgtctgtcaaggactgaagtagctggaaaccaggagtagagaaagatggggggaaaaaaagagcaaggccagaatagaagggagtagactgagtagaatcagttggtggagaggcctatctagataaacctttctgggaggcagggaatgacattttcaggcagggaattgagatgttcagttctgtcctgatacaaggaaagaggcagagcaggagccggcaatgttaaggacaactttttataactgcccagtatttcctgacccctgtcaaaggttggggagaatacaaggtttcttgaagctttttgactggggtgtcacattaggcacacaggtgtctataatggaatctccccttcagtttggtcatagaagtgcttggacaagtcagaaaaatagctagctgtgggtatccctttaagatattcccaagtctaccctgtgtcatagcagtagttctcagagtgtttgtttaaaggatcccactttgaactttgccaagtactaccaactaccttgtctggtgttcagcaactgcccctactgaacagccctttggaactctgaatgatttgggcctcacagaagctccctaaagcctaggaacttggtgactatcatttgaacaactaggcagccatactgcagtcagttgtcatggggtcattccctaggcccccttcctatcagcctctacctaaagaagctagataggaagctaagcacagccatggttgggaggctatatctaaagctcatgaggggtgatcccggggttaccagccttcagcactccctctagcaacaccccattctcttacctagcggggatttgtacctttccactgaggcctctccatgctccttccctacctttcatggcaatactttggcctgcctcttatcctggtactaagttgaagtaaagctcaccctttacttccctacttgaaagttctactctgagccttgactcttagccacagtgaggcatgttgaaggttcctgctggtttattctttttttttttttttttttagacagagtctcactctgttgcccaggctggagtgcagtggcacgatctcggttcactgcaagctccgcctcccgggttcatgccattctcctgcctcagcctcccaagtagctgggactacaggcacctgccaccacgcctggctaattttttgtatttttagtagagacgggtttcaccgtgttagctaggatggtctcgatctcctgaccttgtggtccgcccacctcagcctcccaaagtgctgggattacaggcgtgagccaccgcacccggccttcattcactttctttaaatgcctccaagttgattattctcctagctcatatctccttgatgtgcatgagggagcactgggtctaatttttgggggctgagaaggtaagaaggtgaggtcagtttttcccaggagtcctaaaaaattctggtaccttacattgagggtgtgggagaaagggtgtcatagttctgaaaataggcagtagcatgaagcaccagacctgtctcattccttattagatgtctatctcaaataacagagtttgaaaaatattggttttatcatttgatatttccatgcctgactcgggaaaataacattttctgacttctttctattttcttgccctgcacagaccctacctggtacaattttctatttcttagctcaaagtgtctatacaatgggttgcctggtatgtcagctgccctcactcttgtgtaatagaaatatattgccaggctggggacgtggaggagacgaactggattcctccctcctcctgttgccaggcctctctgcattggcactttatcctttcagtgtttctggctgtgttgggttcatttgtgagactgatgtaacaataaagtgaaatcttcccctctg

SEQ ID NO: 20688 - DNA, 1156 bp, Homo sapiens
ctggaagtgagagcagatccctaaccatgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccgatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgttccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacac

SEQ ID NO: 20689 - DNA, 2772 bp, Homo sapiens
gggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggc

SEQ ID NO: 20690 - DNA, 2066 bp, Homo sapiens
aagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacagaaacaggaaaataaaatatgaatacaatcc

SEQ ID NO: 20691 - DNA, 1952 bp, Homo sapiens
ggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacggagccgggccgcgtggaggcgttgcagcagccctacgtggaggcgctgctgtcctacacgcgcatcaagaggccgcagaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttattt

SEQ ID NO: 20692 - DNA, 1466 bp, Homo sapiens
gacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactggggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatccctt

SEQ ID NO: 20693 - DNA, 2362 bp, Homo sapiens
agatgagactgcatggggcgggaactagagatggaggactttcccgcgcaagggggacaggctggactgaaagaggacacgggaagaacaaagacttagactcgaagccctcggatggtggcccttgcatgcttcagttcatgatgttggagactatttccccacccttgcggaaaaaccttctctctgtgccatgcagctactgccagggatggaggatggcgggaattggcaactaaagactgtcctcctaccctcttcagtgtgtccttcagcaatatgaagttaaaaccagtcttgctctgtccccaggctggagtgcagtggcacgatcttggctcactgcaacctccgcctcacgggttccagcgattctcctgcctcagtctcctgagtagctgggactacaggctcagagaagcgcatgaatgagctaaagccacaaagcgcggggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttattt

SEQ ID NO: 20694 - DNA, 2743 bp, Homo sapiens
ggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccatccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaatgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 20695 - DNA, 4417 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaatgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 20696 - DNA, 4306 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaatgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 20697 - DNA, 2406 bp, Homo sapiens
ccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaa

SEQ ID NO: 20698 - DNA, 1937 bp, Homo sapiens
aggttctctaatgatcttggttcaccatggctacaaatatggaggggctggttcagcacagagtggggacccagcaggtggctgaggtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaa

SEQ ID NO: 20699 - DNA, 1791 bp, Homo sapiens
atgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatag

SEQ ID NO: 20700 - DNA, 2494 bp, Homo sapiens
aacattcgccctcctcctaccagcgcgcgggcggcggcggcggcggcaccggggtcacgaactctgacctttcactgacaaaaacaataacaaacccccccttctccgcgaccccggcggcgcccccgggcccgtccccgccaccccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaa

SEQ ID NO: 20701 - DNA, 495 bp, Homo sapiens
gcccccgggcccgtccccgccaccccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggaccgcctatggctgcggtagcagtgagagaagctctcagaaggtgcacattcctccttgttcatttttaagcagcttccaaagctgctgttgatgatgcctgatgctgctttgaaggcagaaaaccaacagtgagatcaagaattgtaacacgtacacagacctctcggccggaatctccagggatgaccagcccctccccacgcatccagataatctccaccgactctgctgtagcctcacctcagcgcattcagggctctgaacctgcctctggcccattgagtgttttc

SEQ ID NO: 20702 - DNA, 739 bp, Homo sapiens
gttctctaatgatcttggttcaccatggctacaaatatggaggggctggttcagcacagagtggggacccagcaggtggctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatgtg

SEQ ID NO: 20703 - DNA, 2612 bp, Homo sapiens
agaaatgtttcgagctggggcagagggagcagagaaggagccctcaccgcggccggaatgcagagcggaccctggcccaggactgggtttccctttaggctcgggcctaccctggccctcgctgttggaatctccaggaggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaattt

SEQ ID NO: 20704 - DNA, 3212 bp, Homo sapiens
ggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaa

SEQ ID NO: 20705 - DNA, 517 bp, Homo sapiens
aggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgcc

SEQ ID NO: 20706 - DNA, 3732 bp, Homo sapiens
cctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaagaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaaccca

SEQ ID NO: 20707 - DNA, 5275 bp, Homo sapiens
agccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaa

SEQ ID NO: 20708 - DNA, 3501 bp, Homo sapiens
ctccttccctcgtcctgggtcccggggtcctgggtacgtttggctagcctgctctggcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaa

SEQ ID NO: 20709 - DNA, 2214 bp, Homo sapiens
aggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttgcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcactta

SEQ ID NO: 20710 - DNA, 1712 bp, Homo sapiens
gcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtgccggccgcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaa

SEQ ID NO: 20711 - DNA, 1804 bp, Homo sapiens
gtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgca

SEQ ID NO: 20712 - DNA, 1392 bp, Homo sapiens
atggccatggtgaccggcggctggggcggccccggcggcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacag

SEQ ID NO: 20713 - DNA, 3150 bp, Homo sapiens
cgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaa

SEQ ID NO: 20714 - DNA, 5712 bp, Homo sapiens
attgctctacccaccgtcagcagggcgactgccactgccgggattatcatcctctccatcctcaccgccgatcagccaatattggacttgctggtggcggcggcagcagcggcggcgggagtctagccgttccccttcccccgccccagcctccccaccatgtcctagaaaagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatcacc

SEQ ID NO: 20715 - DNA, 5909 bp, Homo sapiens
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatc

SEQ ID NO: 20716 - DNA, 5893 bp, Homo sapiens
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttacttt

SEQ ID NO: 20717 - DNA, 2967 bp, Homo sapiens
atggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaaggtaaatgttcatggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtga

SEQ ID NO: 20718 - DNA, 3822 bp, Homo sapiens
ggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggg

SEQ ID NO: 20719 - DNA, 2283 bp, Homo sapiens
aaaagggccagccctccagctggcccactccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaaaaaatatatacagattcctgttgtgtaataacagaactcgtggcgtggggcagcagctgcctctgagccctcgctcgtccacggtcttctgcatcactggtatacacactcgttag

SEQ ID NO: 20720 - DNA, 2668 bp, Homo sapiens
ggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttgg

SEQ ID NO: 20721 - DNA, 2132 bp, Homo sapiens
ttcctggtgtaagctttggtatggatggtggccgtctccctacagactgggagctgttagagggcagggatcctagctgacacatctatgtcctcgccttggttggaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgca

SEQ ID NO: 20722 - DNA, 2639 bp, Homo sapiens
agtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactga

SEQ ID NO: 20723 - DNA, 2518 bp, Homo sapiens
ggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttgg

SEQ ID NO: 20724 - DNA, 3511 bp, Homo sapiens
tttctccgccggctgcgggaaccggttccaggagcgcgggagctcgtctgccaggagacccagccgggagggaccgatgctgcgtgatgcaaccccttcgagggactgagtcaagaaaccaaggctgggggtctcgtggagtcaggcggagctggggattaggactcggggcttgtgtctcccaggcgtgtttttttgttgttgttttgtttttttgccgcaacatcttccttatactgggtggggtgggggcgggggtggtctgtatttccagacctcctccatggtggtctggctgtgtggagggcagggcacagttccttgacttggctcattcccccccaacgccccccctttcttttttttttgagatggagtctcgctctgttgcccaggctggagtgcagtagcgtgatctcggctcactgcaatctccgtctcccgggttcaagcgaatctcctgcctcagcctccagagtagctgggactacaggcacccaccaccacgcccggctaatttttgtatttttagtagagacagggtttcaccatattggccaggctggtctggaactcctgaccttgtgatccgcctgcctcggcctcctaaagtgctgggattacaggcgtgagccaccgcgcctggcaggctcattccctttttatgccttcgtttttgatagatgacctggggatgggagaaatgctgcagaggtggtttatttacagtgaattgttaatttggttgtggggctagtattaggggcacattgggaaaacacaggctgggcagaggttggtaggttcacaacagttatgcccactgggtgctgatggatttgggggctgtcgtcggcctggcttggggccctagtggtggggctacaaggcttgctcctagatctactccaagtgaacatttaagatcagtgacttggatggagacttaaaaaggaagtcagctgactccgtgtagtcatccagagctgtgaggaatgacaagtgcacagtataaaatcaagattctaattgaaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttgg

SEQ ID NO: 20725 - DNA, 1101 bp, Homo sapiens
agtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaaggtaccgcgcagccccaggtggggccttttgttggaaatggagagaggctggcctcatcccattgggacctgtggtctccccctgggttctcctcctagctaa

SEQ ID NO: 20726 - DNA, 2029 bp, Homo sapiens
tgtaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgca

SEQ ID NO: 20727 - DNA, 3472 bp, Homo sapiens
acataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaacagaa

SEQ ID NO: 20728 - DNA, 2878 bp, Homo sapiens
ctccccggctcccttcttggtcggccgcgaccccccgaaaggtaacaggcctctttcgcccccggccaggacctgggccctgtgggctttttttttttccattttatcagtaagttccccttgtcccagcctccgctttcacttcccgcgttccctccaccccaaaaaccgccccaacatgtccagagaggggcatctacccagccgcccagccaggggcgaccactttgtgagccccggggagcgggacccgtaccaggcgcgcccagcgggggatgcggtgaccgaggggccgggagcgccgggcagggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaa

SEQ ID NO: 20729 - DNA, 2265 bp, Homo sapiens
ggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgc

SEQ ID NO: 20730 - DNA, 2450 bp, Homo sapiens
aagttgcctgaaatttctggttttgacatatgctgtccttgggtttgcgaatgtatcagagcgagaatatgaatatgtaaagagtacagttatgaaactgtggagctaccagggggttaatatccaacacaggaatatctctaagggctgtggggttcgagtctcctttctgctttttctggggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgc

SEQ ID NO: 20731 - DNA, 1010 bp, Homo sapiens
taaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctcc

SEQ ID NO: 20732 - DNA, 2642 bp, Homo sapiens
ataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaa

SEQ ID NO: 20733 - DNA, 2465 bp, Homo sapiens
aaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaa

SEQ ID NO: 20734 - DNA, 768 bp, Homo sapiens
gtggaggaggaaggagatgtgtcaaacagaggagtggagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactggg

SEQ ID NO: 20735 - DNA, 3104 bp, Homo sapiens
gggaggaggaggaggacggacggacagggccagcctgctgtccggctgccgcccgccgtggtgtgagggggtttctgcgcacccacagtcgccaccgtcccacctgggctgccggagcctccccctggacccctggtgcccactgccaccctcatccggtgtgagagcgctgcttccgcttcgcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgggccactggctggctacctctaccctgcctttcctggccgtgccatcaagtctgagtacccggagccttatgccagccccccacagcctgggctgccgtacggctacccagagcccttctctggagggcccaacgtgcctgagctcatcctgcagctgctgcagctggagccggatgaggaccaggtgcgggcccgcatcttgggctgcctgcaggagcccaccaaaagccgccccgaccagccggcggccttcggcctcctgtgcagaatggccgaccagaccttcatctccatcgtggactgggcacgcaggtgcatggtcttcaaggagctggaggtggccgaccagatgacgctgctgcagaactgctggagcgagctgctggtgttcgaccacatctaccgccaggtccagcacggcaaggagggcagcatcctgctggtcaccgggcaggaggtggagctgaccacagtggccacccaggcgggctcgctgctgcacagcctggtgttgcgggcgcaggagctggtgctgcagctgcttgcgctgcagctggaccggcaggagtttgtctgcctcaagttcatcatcctcttcagcctggatttgaagttcctgaataaccacatcctggtgaaagacgctcaggagaaggccaacgccgccctgcttgactacaccctgtgccactacccgcactgcggggacaaattccagcagctgctgctgtgcctggtggaggtgcgggccctgagcatgcaggccaaggagtacctgtaccacaagcacctgggcaacgagatgccccgcaacaacctgctcatcgaaatgctgcaagccaagcagacttgagcctgggccgggggcggggccgggactgggggcgggactgggggcggggcctgggcggggccgcagccacaccgctggctccgcatggttcattttctgatgcccaccgaggagccccagccccgtcccagaggccgctgcccctgagttctgacactgtgtgtttgggaaggtgggtgaggctgggcagggcctggcggaggtggagtggccactggcacttgcctgctgcttggagtgccccaaggaggtggctgttaaccacccgccccgccccctccctgctcccagctctctctcctggagtctgaagcctgcaggtccggggaggaggttcgggattccctggtgggcctcgacgtcccttggatcagaggtcatcccttcctcctctcctggaaacagacagggagaagttgagcaggtatcaactaggggaggagagagggtctccagtgttccccccatagagaccaggagggagagcctctgttttgtaaactaaggataaccgagtttgctaaattgagaggggctattgggccctagaggacactaggagactggttaggacaaaaagaccttctccctagcccttctaccccacctgacctctgcaagagggggcattgatacatcatcgggaaaaaactttgctccaggcatcactgattccctctcccacccaaggagaacgtttggtacaatcgacatcctagccccacccagaggtggccctcccaggctggtatttatctgcaaggttgtagtcaagaggtttttctccccgctttttgtttttaagcttctagacactccttgaaatgtgtgtgtgatggagggaaggggacagatttgaggactgaagctggggcttggggattgccactaagtacagctgacggtttctccccggacactcgcctactaagtacccttggggtggtgctgggtcattacttctgagccccagccccaatccagagaagcgctgttgcccgccctccacccactaggtgaacagcaggatgccctgttgggggcttcaggtctctgtgggtgggaatgcaagtgaacttgggagggggcacgggcctgtagatcagggatagcgctgttgatcccctctctgtggctccaacccgttgggtcccttgctgcaaacccatgaagctggccctcagctccctgaccccctgtcctaggtcatgaaggacactctgcagggtgaagcaccagggagaggcctcggctgtctcctgtccccggcggggtgcctgctgtccgtcccgctttcatgttactgttgcagcttgtgctgagcctgcccagttggaggagactgggcacccctgcctcctgcctcccgcctcccgccaccctgtctcagtacctcccctccccgccccctgaaacatgtgcccctgccaaggccggagacccacagccctgaaacgagaagtgcccttaaggatcaccccagcccccacagccctggaataaatttcgcaattagtttcc

SEQ ID NO: 20736 - DNA, 826 bp, Homo sapiens
ttggcccaggcctctaatggccagcctccttctgcagtgcctccctgcagcctgggccggccactgcctgctccacttagtgaccggtgccccctgctctgggcagggaaggtgccaggggtctcccagactcaccctcccaccatgctaccccctcttcttccctgggctgccgatgggaggagccaggcctgtgaccacaagccccatggaggtccgctggtgtcccgctgtctctggccaggcatccaccaggctgtgtgggtctgagcctagaggcggacgccgcgggcatggactattcgtacgacgaggacctggacgagctgtgccccgtgtgcggggacaaggtgtccggctaccactacggactgctcacgtgtgagagctgcaagggcttcttcaagcgcacggtgcagaacaacaagcactacacgtgcaccgagagccagagctgcaagatcgacaagacgcagcgcaagcgctgtcccttctgccgcttccagaaatgcctgacggtggggatgcgcctggaagccgtgcgcgctgaccgtatgaggggtggccggaacaagtttgggccgatgtacaagcgggaccgggccctgaaacagcagaagaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgcccacgg

SEQ ID NO: 20737 - DNA, 972 bp, Homo sapiens
gatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaagggtctcactctgtcgcccagtctggagtgcagtggctcttggctcatggcaacctccacctcctgcattcaagtgattcgcctgcctcagcctcccgagtag

SEQ ID NO: 20738 - DNA, 3115 bp, Homo sapiens
atggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaata

SEQ ID NO: 20739 - DNA, 1793 bp, Homo sapiens
aagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaagggtctcactctgtcgcccagtctggagtgcagtggcacgatcttggctcatggcaacctccacctcctgcattcaagtgattcgcctgcctcagcctcccgagtagctgggattacaggcgtgcaccacaacacccatctaatttttgtatttttagtagagatgggattttgccatgttggccaggctggtctcaaaactcctgacctcagggtgatctgcctgcctcggcctcccaaagtgctgggattatgggcatgagccactgcgcctggccgtaattgtgcttttttttccttttttctttttttgagatggagttacactcttgttgcctgggctggggtgcaatggcacagtctcggctcactgcaacctccacctcctgggttccagcaattctcctgcctcagcctcccgagtagctgggattacaggcatgcgccaccatgcctagctaattttcgtattattagtagaaacaaggtttcaccatgtcagccaggctggtctcaaactcctgacctcagatgatccacccgccttggcctcccaaagtgctgggattacagatgtgagccaccacgctcagccaaattgtactttcagtaaagtactttactgtttacaaagaacttccatatacatttttttggtcctggtctctgtctttcattttgggagcatggatgtaactggcctttcatcaatggttcagtagtgttgttttttaaagcctacaacagaaccatctcctatgaattgactatcacctgtctaaatgccctgtttacagcatgttgtacctgcaagagcaggatatttaaagtactttataattgataattgccattatcaatatgctcacctctttaccatattccaacaggtcttaaaggacttgtattattttttaccgaa

SEQ ID NO: 20740 - DNA, 5086 bp, Homo sapiens
gaaactggatacatggtttacagcaggtcactaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattggtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagtggggagggggaagaagaacaggaagaaaaaaagtactctgaactgctccaagtaacgctaattaaaaacttgctttaaagatattgaatttaaaaaggcataataatcaaatacttaatagcaaataaatgatgtatcagggtatttgtattgcaaactgtgaatcaaaggcttcacagccccagaggattccatataaaagacattgtaatggagtggattgaactcacagatggataccaacacggtcagaagaaaaacggacagaacggttcttgtatatttaaactgatctccactatgaagaaatttaggaactaatcttattaattaggcttatacagcgggggatttgagcttacaggattcctccatggtaaagctgaactgaaacaattctcaagaatgcatcagctgtacctacaatagcccctccctcttcctttgaaggccccagcacctctgccctgtggtcaccgaatctgtactaaggacctgtgttcagccacacccagtggtagctccaccaaatcatgaacagcctaattttgagtgtctgtgtcttagacctgcaaacagctaataggaaattctattaatatgttagcttgccattttaaatatgttctgagggttgttttgtctcgtgttcatgatgttaagaaaatgcaggcagtatccctcatcttatgtaagtgttaattaatattaagggaaatgactacaaactttcaaagcaaatgctccatagctaaagcaacttagaccttatttctgctactgttgctgaaatgtggctttggcattgttggatttcataaaaaatttctggcaggaagtcttgttagtatacatcagtctttttcatcatccaagtttgtagttcatttaaaaatacaacattaaacacattttgctaggatgtcaaatagtcacagttctaagtagttggaaacaaaattgacgcatgttaatctatgcaaagagaaaggaaaggatgaggtgatgtattgactcaaggttcattcttgctgcaattgaacatcctcaagagttgggatggaaatggtgatttttacatgtgtcctggaaagatattaaagtaattcaaatcttccccaaaggggaaaggaagagagtgatactgacctttttaagtcatagaccaaagtctgctgtagaacaaatatgggaggacaaagaatcgcaaattcttcaaatgactattatcagtattattaacatgcgatgccacaggtatgaaagtcttgccttatttcacaattttaaaaggtagctgtgcagatgtggatcaacatttgtttaaaataaagtattaatactttaaagtcaaataagatatagtgtttacattctttaggtcctgaggggcagggggatctgtgatataacaaaatagcaaaagcggtaatttccttaatgttatttttctgattggtaattatttttaacagtacttaattattctatgtcgtgagacactaaaatcaaaaacgggaatctcatttagactttaatttttttgagattatcggcggcacaatcactttgtagaaactgtaaaaaataaaagtatctcctagtcccttaattttttcataaatatttctggcttttgagtagtgtatttatattgtatatcatactttcaactgtagacaattatgatgctaatttattgtttcttggtttcacctttgtataagatatagccaagactgaagaaaccaaatatatgtgtttactgtagcatgtcttcaaattagtggaacttagttcagggacatagaagagtcttaatgaattaaaatcattcacttgattaaatgtctgtaaatcttcatcattcctactgtagtttatttaatatctattgtaaattatgtgacttgtagcttcctctggttttcaagtaaactcaacaaggtggagtcttacctggttttcctttccaagcattgtaaattgtataccaaagatattagttattacttctgtgtgtacaaagaggattattttattatgtttattaatcacctctaatactcatccacatgaagggtacacattaggtaagctgggcgttgactcatgcgcagtctcagtcacccgtgttatcttcgtggctcaaaggacaatgcaaaatcgccgatcagagctcatacccaaagcattacagagaacagcagcatcattgccctccccagctgaaaaacaagttggctagaagatacatggagaggaatggtgtggtcaacagttaatgaaacggttctatcatgcatgtgtaatgtggatggagacaattataagatttgactataactatttggagggtctttaacattgccaaaaaaacaaatatgttgatttttattttattttattttttattttaagaggcgggatcttgatctcacatgttgcccaggctggccttgaactcctgggctcaagcattcctcctgcctcagcctcccccatagctgggactaggggtgcatgccagcatacctggctacgttgactcttaaaatctatgttctcttattttaaagatacagtgctccccactgaaaattaaacctaaaaaatgtcacatattggtatgttgttaacctggtagattaaatcatgagaatgattagaaagacgggcaacacagcgggttacatccacactgctgatcacaccaacgacaggagctgataagcaagaaagcgtcacagccagcgtctgttcacccaaggttgacaagtgaagtttctctaatgttgattgttagccgatttgtaacctggcatttacttagcaactgccttatcaattacaggatttgccggtaaaagcagactcaaatataaaggtttttggcttaacttggtttattatagttgctctatgtttgtaaacagacaatctctaatgtctgattatttgtatcacagatctgcagctgccttggacttgaatccatgcaatgtttagagtgtgaagtcagttacttgttgatgttttcttactgtatcaatgaaatacatattgtcatgtcagttcttgccaggaacttctcaacaaaatggaattttttttttcagtatttcaataaatattgatatgcccagcctgataatttttaaaa

SEQ ID NO: 20741 - DNA, 213 bp, Homo sapiens
gtctttaaagcacggacttacacctattgatcgaggaaattgccgctctggctgcttctccttcgccgccacgctcagacagaggtcgcttctgactagctgtgctgggcttccggaccgacacggatcccccatccccgcccgcggtcgccttgtcatgctgcccaaagtggagacggaagccctgggactggctcgatcgcatggggaaca

SEQ ID NO: 20742 - DNA, 574 bp, Homo sapiens
actaatgttggaaaaagtacagagtccagggaaagacttgcttgtaactttatgaattctggatttttttttttcctttgctttttcttaactttcactaagggttactgtagtctgatgtgtccttcccaaggccacgaaatttgacaagctgcacttttcttttgctcaatgatttctgctttaagccaaagaactgcctataatttcactaagaatgtcttctaattcagatactggggatttacaagagtctttaaagcacggacttacacctattgataacacagaaaatacaggcacaagaaagatgagagagcagcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgcccgcgcgggcggtcttgggctcctgctgcgcgcagccccagctggccgctgccaaaatagagttgagctgggtcg

SEQ ID NO: 20743 - DNA, 1698 bp, Homo sapiens
atgtcttctaattcagatactggggatttacaagagtctttaaagcacggacttacacctattgatcgaggaaattgccgctctggctgcttctccttcgccgccacgctcagacagaggtcgcttctgactagctgtgctgggcttccggaccgacacggatcccccatccccgcccgcggtcgccttgtcatgctgcccaaagtggagacggaagccctgggactggctcgatcgcatggggaacagggccagatgccggaaaacatgcaagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataa

SEQ ID NO: 20744 - DNA, 1852 bp, Homo sapiens
gtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgagtgtctcaatttaaaatggtgaattactcctatgatgaagatctggaagagctttgtcccgtgtgtggagataaagtgtctgggtaccattatgggctcctcacctgtgaaagctgcaagggattttttaagcgaacagtccaaaataataaaaggtacacatgtatagaaaaccagaactgccaaattgacaaaacacagagaaagcgttgtccttactgtcgttttcaaaaatgtctaagtgttggaatgaagctagaagctgtaagggccgaccgaatgcgtggaggaaggaataagtttgggccaatgtacaagagagacagggccctgaagcaacagaaaaaagccctcatccgagccaatggacttaagctagaagccatgtctcaggtgatccaagctatgccctctgacctgaccatttcctctgcaattcaaaacatccactctgcctccaaaggcctacctctgaaccatgctgccttgcctcctacagactatgacagaagtccctttgtaacatcccccattagcatgacaatgccccctcacggcagcctgcaaggttaccaaacatatggccactttcctagccgggccatcaagtctgagtacccagacccctataccagctcacccgagtccataatgggctattcatatatggatagttaccagacgagctctccagcaagcatcccacatctgatactggaacttttgaagtgtgagccagatgagcctcaagtccaggctaaaatcatggcctatttgcagcaagagcaggctaaccgaagcaagcacgaaaagctgagcacctttgggcttatgtgcaaaatggcagatcaaactctcttctccattgtcgagtgggccaggagtagtatcttcttcagagaacttaaggttgatgaccaaatgaagctgcttcagaactgctggagtgagctcttaatcctcgaccacatttaccgacaagtggtacatggaaaggaaggatccatcttcctggttactgggcaacaagtggactattccataatagcatcacaagccggagccaccctcaacaacctcatgagtcatgcacaggagttagtggcaaaacttcgttctctccagtttgatcaacgagagttcgtatgtctgaaattcttggtgctctttagtttagatgtcaaaaaccttgaaaacttccagctggtagaaggtgtccaggaacaagtcaatgccgccctgctggactacacaatgtgtaactacccgcagcagacagagaaatttggacagctacttcttcgactacccgaaatccgggccatcagtatgcaggctgaagaatacctctactacaagcacctgaacggggatgtgccctataataaccttctcattgaaatgttgcatgccaaaagagcataagttacaacccctaggagctctgctttcaaaacaaaaagagattgggggagt

SEQ ID NO: 20745 - DNA, 2424 bp, Homo sapiens
gaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtca

SEQ ID NO: 20746 - DNA, 2481 bp, Homo sapiens
gaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctctttatggcagatcgtgcaggtcgcaagtggatcctgactgacaaagccacaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtca

SEQ ID NO: 20747 - DNA, 3330 bp, Homo sapiens
ggcggcagaagcggcagcgctcgccattgccgctggtggcaggaggctgcgaggagccggcgcggtcgcagtctccacggcgcaggcccacggtagcgcagccgctctgagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacagg

SEQ ID NO: 20748 - DNA, 3523 bp, Homo sapiens
cccctttcagttcctggtccagaactttacacagaaaaggtgctcaaaggatatttgtttaatgaatgtggtatgctgacatttaaacaggacaaaacttgtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaggaa

SEQ ID NO: 20749 - DNA, 1776 bp, Homo sapiens
catggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctctttatggcagatcgtgcaggtcgcaagtggatcctgactgacaaagccacaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgc

SEQ ID NO: 20750 - DNA, 3528 bp, Homo sapiens
ggcggcagaagcggcagcgctcgccattgccgctggtggcaggaggctgcgaggagccggcgcggtcgcagtctccacggcgcaggcccacggtagcgcagccgctctgagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacagg

SEQ ID NO: 20751 - DNA, 814 bp, Homo sapiens
tggtggcaggaggctgcgaggagccggcgcggtcgcagtctccacggcgcaggcccacggtagcgcagccgctctgaggctggagtgcagtggtgtgatctcggctctctgcaacttccacatcccgggttcaagcgattctactgcctcagcctcccgagtagttgggactacagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgggaatggccgctgctgctgctgtggcaacaggaaagaaacggaaacggcctcatgtatttgagtctaatccatctatccggaagaggcaacaaacacgtttgcttcggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatccc

SEQ ID NO: 20752 - DNA, 1531 bp, Homo sapiens
attgccgctggtggcaggaggctgcgaggagccggcgcggtcgcagtctccacggcgcaggcccacggtagcgcagccgctctgagtagaacttcatggaggaacacggagtgacccaaaccgaacatatggctaccatagaagcacatgcagtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggaaacttcgagccacgttagatgaatatactactcgtgtgggacagcaagctattgtcctctgtatctcaccctccaaacctaaccctgtctttaaagtgtttggtgcagcacctttggagaatgtggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggttggtacgggggcaacagtagccacattggctgatgcttcagaattgccaaccacggtcaccgttgcccaagtgaattattctgccgtggctgatggagaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttc

SEQ ID NO: 20753 - DNA, 2346 bp, Homo sapiens
cggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatttc

SEQ ID NO: 20754 - DNA, 1144 bp, Homo sapiens
gagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctga

SEQ ID NO: 20755 - DNA, 4120 bp, Homo sapiens
tataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaacaacctaagacaggcacagtcgcagaggggccatcaggagagaacttgggggcaacagaggtggggcatggaccctcacccccacaatcctacaggggcctgaaccctcacaccttctgagggaggtctcctgcccccatggctgctttgcttcccacgcccagttcagatcgggacccaggtagcagacagagacctggccaacagcaagtgcccactcaccacagcaaggatttgtttctcatttctaccttggaccacagggatggggcagctgaaagaaagggctgtgtcagggtgtctttctcccttttctccctcatttttctagatgcttttttgccttgtagttctttctctttttctttgctttctctttcctttttctgtctgtctcctatacctccccatctctcccttgcccctgccccatcttgcctttttctctttttcctccttttcctttcttattcctttgcctctcctcttcctgagccccacctgctcatctccctgccccaacatcctgtgccatccctgtggtgtgtttgggtcttggccaaagccagacctggcagaactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgt

SEQ ID NO: 20756 - DNA, 2795 bp, Homo sapiens
atagagacaacagtcaggggctggtggtggtgcttttgggggtctaggagagcccaaggccctgatattttaaaatgtcctcctcggcatctccagcaagttgccactgctggcgaagaaagcgaggtatagacaaggagccgagctgaaacactggctagattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgta

SEQ ID NO: 20757 - DNA, 3848 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 20758 - DNA, 2322 bp, Homo sapiens
ttgtggcaagattctgaggggaagtgtagctcccaggttggttccaagtcttcttccaattaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 20759 - DNA, 2934 bp, Homo sapiens
cctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgtt

SEQ ID NO: 20760 - DNA, 3192 bp, Homo sapiens
cctgactcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagggatgatgcttcctgtctgtcacaaggctgagtgaacacaacatgcctgtaggtccagaacattcttcctacagagaccagatgtccagaaagccctatctgctggattcagggaacgcctctcctcatttctgtcacactatttgcaaaagcctccttctctgagatcttcaaagctgcagttctagccacagtctgcagggagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacagtaagtgaccaggcagcctggtttgcacgtagcagcccccgggactgtgcaaccctttcattctctgtggtcttccttttcttctctcattagagaactgacgaatgctggaagtggaatagtggctgagcaatcctaattgtagccctggcgtcagtgagtggagcatgtataggagactttcttagatttaatggatacccgccttctctcctcttccccacagcactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 20761 - DNA, 3959 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcaggatcttatccaggacgcttcattgcatttggtcttcatttctccttagtctcctccaggctgacatttcctcaatctttattggtcttccacagccctgacacttttggagataccagtcagcatttccaagttcgttctgtgagactgtagtgtcaggacaaagcaacaacaaaatgtgctctactctaaagaagtgtgggacatacagaactgaagttgcagaatgccatgaccatggtagcacttttcaaggaagaaagaaaggtgggagttctttccgggataattttgacaagaggagctgtcattatgaacatggtgggtatgagcgcccgccttcacactgccaggagaatgatggaagcgtggagatgagggatgtccacaaggaccaacaactaagacacactccttatagcatccgatgcgaaagaagaatgaaatggcatagtgaagacgaaatccgtattaccacgtggagaaatagaaaacctccggagagaaaaatgagtcagaacacacaggatggatacacaaggaactggtttaaggtcacaattccttacgggataaagtatgacaaggcatggctaatgaattcaatccagagccattgcagtgaccgcttcactccggttgatttccactacgtccgaaatcgggcatgcttctttgtccaggatgctagcgctgcctccgcattgaaggatgtcagttataagatttatgatgatgagaaccaaaagatatgtatatttgtcaatcattctactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcattgaaagaaatttccctgagctgttgtctttgaacttgtgcaacaacaagctgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtccgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagtattactcgatctatgactctggagatcgacagggtctcctcggtgcttaccacgatgaggcctgcttctccttggctattcccttcgaccccaaggactcagccccgagcagcttgtgcaagtactttgaggatagcaggaatatgaaaacactcaaggacccctacctgaagggggaactgctgaggcgcacaaaacgtgacattgtggactccctcagtgcgttgcccaaaactcagcatgacctcagctccatcctggtggacgtgtggtgccagacggaaaggatgctctgcttttctgtcaatggggttttcaaggaagtggaaggacagtctcagggttctgttctcgccttcacccggaccttcattgctacccctggcagcagttccagtctgtgcatcgtgaatgacgagctgtttgtgagggatgccagcccccaagagactcagagtgccttctccatcccagtgtccacactctcctccagctctgagccctccctctcccaggagcagcaggaaatggtgcaggctttctctgcccagtctgggatgaaactggagtggtctcagaagtgccttcaggacaatgagtggaactacactagagctggccaggccttcactatgctccagaccgagggcaagatccccgcagaggccttcaagcaaatctcctaaaaggagccctccgatgtcttctttgtcttcgttcacatcctctttgtttcctcttttcaccagcctaaggcctggctgaccaggaagccaacgttaacttgcaggccacgtgacataaccacccaaagagccagttgctctgtgtattcgccccactcatgatcaccattttattttcataataaagagtgacgttacacgttgta

SEQ ID NO: 20762 - DNA, 1938 bp, Homo sapiens
ttgctctcgccttcgtcagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgcaaaa

SEQ ID NO: 20763 - DNA, 1196 bp, Homo sapiens
agcaaactttggggagtggtaagaacaggaagttaattctgtgactcctaggacactcctctctatgcttggggaaggaacttcctgtaagcaaggcttgaggcttgctctcgccttcgtcagcagccctcctcaatcttctccaaactcccgtccccaggccacacagattctcctcaagagagccctataaggacattggtaaaatgtcactgccttcaggacacactacggcactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaagtcagttgtaccctctgtcaccacctgggaccctgacctgtgtttgatagcgcccttctgcaggaggaggcagcactagtcttctgggaggaccacagaccctctccttccccctcgccccactcctctctctgtgtcactcattcatctgtgcttagacatctcctttccttcctctgacatggtccccttttcacccgctctgggatgtgtttcccacctgtctccacccagcctcctctagcgtgccctctgtgagtgtgctccag

SEQ ID NO: 20764 - DNA, 1837 bp, Homo sapiens
atcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaaggtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtc

SEQ ID NO: 20765 - DNA, 1081 bp, Homo sapiens
caatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtctcagggttctgttctcgccttcacccggaccttcattgctacccctggcagcagttccagtctgtgcatcgt

SEQ ID NO: 20766 - DNA, 2062 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtggtggtgtttgttgtctctgaagtggaaggatggtctcagggttctgatcttgccttcatgtggaccttcatcactacctctggccgcaattccagtctgtgcatcatgaatgataagctgtttctgagggatgccagcccccaagagactcagagtgccttctccatcccagtgtccacactctcctccagctctgagccctccctctcctaggagcacaggaaatggtgcaggctttctctgcccagtctgggatgaaactagagtggtctcagaagtgccttcaggacaataagtggaactacattagagctggtcaggtcttcactatgctccagactgagggcaagatcccagtggaggccttcaagcaaatcccctaaaaggagccctttgatgtcatctttgtcttccttctcatcctctttgtttcctcttttcaccagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 20767 - DNA, 1554 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagaggtggtggtgtttgttgtctctgaagtggaaggatggtctcagggttctgatcttgccttcatgtggaccttcatcactacctctggccgcaattccagtctgtgcatcatga

SEQ ID NO: 20768 - DNA, 1348 bp, Homo sapiens
acttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagcctaagaccactctaaggactggggttggaggcctggctgaccaagaagccaaagttaacttgcaggccacaggacatagccacc

SEQ ID NO: 20769 - DNA, 1613 bp, Homo sapiens
tccaggtttgttctggaaaacactaggtctgagagacagcaacaacaaaagtatactctaccattaaagaaataatgccgtatatgtagtagcacttttcaaagaaggaagaaaggtgggagtcatttccagggtaattttgacaagaggaactgtcattatgaacatggtgggtatgaacttctgccttcacgctgccaggagaatgatggaagcatggagatgagggatgtccacaaggaccgccaactaagacacactccttatagaatccaatgcaacaggaagctagtgaaatgacatagtgaagatcaaatccatattaccatttggagaaatagaaaacctccagagagaaaaatgaggcggaacacacaagatgaaaacatgaggaaatggttcaaggtcacaattccttatgggataaagtatgacaaggcatggctaatgaattcaatccagagcaattgcagtgtccccttcactccggttgatttccactacatccgaaatcgggcatgcttctttgtccaggttgctagtgctgcctctgcattgaaggatgtcagttataagatttatgatgatgagaaccaaaagatatgtatatttgtcagtcattttactgcgccctactctgtgaagaataagttgaagccaggccaaatggagatgctaaagctgaccatgaacaaacggtacaatgtctcccagcaagctcttgatctccagaatctccgctttgacccagacttgatgggccgtgacattgatataatcctgaatcgaagaaactgcatggctgccaccctgaagatcactgaaagaaatttccctgagctgttgtctttgaacttgtgcaacaacaaactgtaccagctggatggcctttctgacattacagagaaggctcccaaagtcaagaccctgaatctctccaaaaataagctggagtcggcgtgggagttgggcaaggtgaaagggctgaagctcgaagagctatggctagaagggaacccgttgtgcagcaccttctcggaccagtctgcctatgtaagtgccatccgggattgtttccccaagttgttacgcctggacggccgagagttatccgcaccagtgattgttgacattgacagctctgagacaatgaaaccctgcaaggaaaactttactggatctgagaccctaaagcatttagtcctgcaattcctgcagcagagcaacttgtgcaagtacttcaaggatagcaggaatataaaaattctcaaagacccctacctgcagaggaagctgctaaagcacacaaaatgtccacgaaacgtggactccctcagtgcattgcctgaaactcagcatgacttcacctccatcctggtggacatgtggtaccagaccgtgaacacctgcttcctccctcgggcaggcccagagagccagagcctaagaccactctaaggactggggttggaggcctggctgaccaagaagccaaagttaacttgcaggccacaggacatagccacctgaagagccagttgttctgtgtatttgccccactcatgatcaccgtttattttcataataaacagtgacgttacatgttgtatgtt

SEQ ID NO: 20770 - DNA, 3811 bp, Homo sapiens
gattcccctttgttcgggttcgccattttgctaggcagcggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcagcagcagggtggtgtcactgctgtgcagttgcagactgaggcccaggtggcatccgcctcaggccagcaagtccagaccctccaggtagtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaaggttttctcattgcatccatactgtgagaataaactgcagactgaaagaaacatgcctgcagggtcaggaactgggccactgttcccagaacgggttgtgcctcagaaatctatttctcttttagatgttgaaccctgagagaactaagatgatatttcagaagagttggctgccttctctggaaacaaggaaaacccaataattccgaggaacattgggggttaaataccaagaataaaaattggttcttctttgacttcagcttaactgtattaagacagaaattaagccctctaaaaacaccacaaagagagatgattgtaatgatagaaatagaggtacagagctatgcaaaggaaacaggaagtgaaatattcctagtcccagggatctggtaatcgctcctggcttccagatgtcaaaggactgatcctttggtaagctcactagaaacttctagctctacaagagtttgggatattaatgttattcagtaagtcccaagtttttcagagaatagattactaacaatgaggaatttatattccttggttaatttaggagtctaagatgcagagttcagaaagaaattactcagacctaactttgagtgcttaagctgccaacagttagaagatgctatttatttgtgtctgtaagtttgtacatagtaatgccagccttgttgctgaattttttatttggggggagatgactttgaattttgtttgaaatgcttcagttgtcattttgtcattgcatttcaaatagctcatgacccttttcttgtggtcactttggcacaccatagtagcccacaaagtgggggcagggtattgacatttggattttttctttgatactagttcttttattcatttttatttgtgactgtagtgataactttacagatggagaaagagtgaatggatgaatgaataattggtttaatgcctagttatgcaacttgagtgcttttttttttttttgcaggataattttaagtgtatatattttaactgcactggtacattgaacatgtcagtgtcgatgccactggaccaacagagcattttgtggctatagggtgcctgataataatgtcttgatttttctttgggattcaactatatcgaaggtttttcccccagcagtatgggggcgtacaggtgatcgatcattaatgtcattgcaattgttattttttaaaataaatttataaaaataaccgaaaa

SEQ ID NO: 20771 - DNA, 1660 bp, Homo sapiens
cggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagattcagcagcaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaaatacagttggtcccacctggacagatccagatccagggtggacaggctgtgcaggtgcagggccagcagggccagacccagcagatcatcatccagcagccccagacggctgtcactgctggccagactcagacacagcagcagattgctgtccagggacagcaagtggcacagactgctgaagggcagaccatcgtctatcaaccagttaatgcagatggcaccattctccagcaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatgatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaaggaaatacctgcatgagtctcggcaccgtcatgccatggcacggaagcgtggtgaaggtggacgatttttctctccaaaggaaaaggatagtccccatatgcaggatccaaaccaagccgatgaagaagcaatgacacagatcatccgagtgtcctaaccccacgccatgtgatggagctgatcaaggtcatgtttctcactgttccaggaaattgatcaactcttccaatgggacattgatgatcacattctgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttc

SEQ ID NO: 20772 - DNA, 3512 bp, Homo sapiens
gtcgcgccgagggaagcggcccgcggcggagggaggggaggccgagtcctggaagcggagctccgcgctgggactggttccttcgcagccattttctgtccaaccaaacagccgattggagacgggagccaaccagggctgcattggaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgtttgcccttttaataaaatataagggtagagttcattttgaatgcaagttgcctttattataaatttgagtttgtcttggttataccttgcatgataacctagctagatttctagcatttgctgtatttattaaaattattatttttttggtaaaacattaatagtttaagcagcatcatttttttaaaaaatgtaattgaataagtgtgaatgcagaagcaaatattgtctgccctgttaaacttggtgcccattaacagtgtttacactgttcatcgtgcctgttaatgtagttttagttactggagcttttttaagactagatttggttttgagttacatttttaagaatgtgggaatatatttaagtttaatgtagtcctagtgctcttgaaatggtgcccctttcatttggtacatgattttttttcaaatcatatcttcaagtactatagtattctcttacagaagaggagttttatagtctgatggtaaatgtcttcattttacctttttaattgaaatgtcaagtttcctgttacactatggaaaccaagaaacatcagacatcattgcgtgtacagaccttttgcatgggtgagtggatgaaatggagaacagagtgagtgctgtgaacggtgtgaaatagaagccaacttctagtatgctgtcttcatctctgcaataaactaaacgtaaataatgtaactttgtataatttagtagtatgtacttggattgtttctttttgaaaagtgaggatttgtattttctcatctattctttttggtgttaattaacttgagggatttcttttttaagtttttaatatcaaaaattgctattgtatagtttgcctaaaaggaagttggagtgaatatcatctttgaaggacactcaaatttataaggtagaagcaatttcccagatataggctgaacagaaacatttactttgccagaaggagcctttaggagtatatgtgggctaatcagaggttaataatgtcctcatctcctactctccatttaaaaaacaaacttcattgtagtaaattcaaataggaaaaaatgggggagtagttaagcaaaatcaacagtcatcctactatgttgaaagaaccaatgttaatattttgataaatatcatttgtccttttactttgctaaatatgtatatttttataaaaatgggctcatattgtgcataccattttgtaacctgcttttttcacttaacaatatattgggaacatcttttccaggtcatgcatagtcttctgcatcatttttattggtttattattctgctgtatgactcaatcataattcatttaatcttctattggatattttgactatttacatcttttcacagttataaacagcacttcactgaatcccatgtacatccatgactgttttcttaaattctttgaattgctgggttaccaaatatgcaaaattttaaggcttttgatacttcgttatgagtgtatttttgagatattttccacttgatccaagcagtgtgtcactatataactgataaaagcacttggtctttgattatcagatactgtctctaaaattattttaaagattaatatttgttcaagtagagaatgaagataaaaaaggaatttgaggccaggtatggggtgtctcatgcctataattccagcactttgggaggccaaggcaggcagatcactttgaggtcaggagtttgagaccagcctggccaacatggagaaccccccgtctctacaaaaaatacaaaattagcagggtgtggtggtgcacacctgtagtcccttactccctggtggctgaggcattatcccttgaacctgggaggcagagcctaaagtgagccgagatcgcgccactgcactccagcctgggtgacacagcaagactcttgtctcaaacaaacaggaatttgagtaaattttaaattagtatatactacaacaaatttccaaacttcataatttgctagtagtgctaactaaaattttacaccaggtaaaatcaggtcaccttttttatgtattgacttcattgttggacttcatactctgatgggaaagaaaatggacattctgaatgtgtcaggtgcataatatcctaatttatgcttgtcagagctggggtctctgtcttccttggcccatgttgcatttaactgaatgtcatgttttctcctctggaacttcttatgtatgcaagctcccatgttaacctatcataaaaatgttttttataattttgtaaa

SEQ ID NO: 20773 - DNA, 1727 bp, Homo sapiens
tcccgccctcccgcgcgggccgaggccgggccccgcgcctgcgaggccgctcccgcagcgggccgggccggggagcgggcgcggggccgcggcgcggctctttgtgcgccgggctgaggagcggcgggacgcgggccaggccacctcaccctcgccgccgttgagctccgggcccggggccgaggaggggccgcggggctgcgtcggggccccgctctcgacggcgtcccgggccggctccattttgtgcggggagccggccgaggggcgggagacgcggcccgggccctggccccgtagccccggcggcggcgcgagtccccgggggcgccctcctcccgcccgcggggctgtggcggggcccggcgctttgtctgcccgcacatcccgggggccgcgcggcgggtgggaggcaggcgttgggcgcggggccggggcggccgggcgagtcaggggatgcgctctgggggcggcctcctggcactcgcagggctgacaggtcgccgggaccaggccgtggggccggggccacccaggcacctgcgtggggaggaaggcatggctttagcttccccgcagcctggtttgcgcgtaaagaatgcagccatctggcggtttgcggtccctgtacttgccccgaaggttgaaatcacaaagattagacacctttttagataggtgttcttcagcaccactgacaacacggttctgacagtatttcatgacaatggatggtgacagttctacaacagatgcttctcaactaggaatctctgcagactatattggaggaagtcattatgttatacagcctcatgatgatactgaggacagcatgaatgatcatgaagacacaaatggttcaaaagaaagtttcagagaacaagatatatatcttccaatagcaaacgtggctaggataatgaaaaatgccatacctcaaacgggaaagattgcaaaagatgccaaagaatgtgttcaagaatgtgtaagtgagttcatcagttttataacatctgaagcaagtgaaaggtgccatcaagagaaacggaaaacaatcaatggagaagatattctctttgctatgtctactttaggctttgacagttatgtggaacctctgaaattataccttcagaaattcagagaggctatgaaaggagaaaagggaattggtggagcagtcacagctacagatggactaagtgaagagcttacagaggaggcatttactaaccagttaccagctggcttaataaccacagacggtcaacaacaaaatgttatggtttacacaacatcatatcaacagatttctggtgttcagcaaattcagttttcatgatctgaagaaatgatggaatggggagtgtagagaaatgagagtctgtatgattctggaacagagacatcagaaggaaagactggtgaaaagatgtatctttgtatattaatagctgtaatgtagcttcctgatgcttgactaattgaggtgttaattctgacttgagaatctttttcatgaatgattttaaagaaaaatttggattttaaaggtattaaaatatttttgttttgtacgagagtttgttgctctgtatgactcctgtatgcattgtatattgcaatttattactgtcagagatttgtagacagtttcttattttcatattgaatcatgttacttttgtaattcaagtaagcggctgggttaattcatgatgttt

SEQ ID NO: 20774 - DNA, 2158 bp, Homo sapiens
gtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 20775 - DNA, 1202 bp, Homo sapiens
gggataggagtgacttaaattctcccagtcggtggaggtataaataactacatgtaaaattaatgcagttcccgttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgc

SEQ ID NO: 20776 - DNA, 2363 bp, Homo sapiens
cagggcttcattggagcctcggagtttttcactgaggcaggggtcagctgaaagacaaagaaaaatggcgaatagtttgttggggggtgggaggacagctgttcgggttttcagtggagtggacattccagactcatgtttctgcatctcctgctgccttttgtttcctccgtcctttggggggtagggataggagtgacttaaattctcccagtcggtggaggtataaataactacatgtaaaattaatgcagttcccgttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagaggaacagcgtgcagcaagctcgagtctctgagctaacgggagaggcagagcccagagaagtgaaagccacaggaaattcaactccctgcacctcttccctgcccaccacacaccccccctcacaccgggctggtgcctcctgtgtctgctgctcccaaccccagcagagctccacttcccctcctccttctgacgccttgcagtgggtggtggttgaggtatctgggacccccaaccagctcgagacccatagggagctgcatgcccctctcccagggatgacctcactctctcctctccacccctcgcagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 20777 - DNA, 1862 bp, Homo sapiens
gtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctaggggacacgggcttccaccatgttagccaggctggtcttcaactcctgacctcaggtgatccacccacctcggcctcccaaagtgctgggattataggcgtgagccaccgtgcccagccaggctatgctgggtgtctttttgagatttaggaacctctcagaataaaatctggaagcctgttccatttgcattatgagatttgcattacaatgcaggctgaagtgcagtagtgcaatcatggctcattgcagtctcccagctcctcggctcaagtgatcctcctgccccagcctcctgagtagcgggagctacagacacacaaacacaggatactgccagaaactgggcaagaggctgtttgtgaatctcagaaggcacccggatcttgctctgctgttcctgctcaggctggagtgcagtggcgcaatcatggctcactgcaggcttgaccacccaggctcaagcagtcctcccgcctcagcctcttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataac

SEQ ID NO: 20778 - DNA, 1455 bp, Homo sapiens
ctcctgctcttcctggactcctgagcagagacgaggtctcgctctgttgccaaggctggtgtgccaggctggagtgccgtggcatgatcatgactcactgcagcctccacctcctgggctcaagcaatcctcctacttcagcctcctgagtagctgggactacagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaa

SEQ ID NO: 20779 - DNA, 1348 bp, Homo sapiens
gcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcgggccaggacctcgcccagcccatgttcatccagtcagccaaccagccctccgacgggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatatt

SEQ ID NO: 20780 - DNA, 989 bp, Homo sapiens
gcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacaggccatggaaacattctttgcatttaagagacagatttattccctgtggagagtgggtggattcattgccacactcttttctcccagggacccaggaaactag

SEQ ID NO: 20781 - DNA, 1005 bp, Homo sapiens
gcggcgagagggcgagcctagaggctttaagggggaagagagggtgatggcctggcagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggagacaggtcttgctgtgtcactcagactgatgaagtgcagtggcttgatctcagctcactgcagcttccgcctcccaggttcaagcgattctcctgcctcagcctcccgagtagctgggattataggtgcagctgaatgccggccagctgcagtatatccgcttagcccagcctgtatcaggcactcaagttgtgcagggacagatccagacacttgc

SEQ ID NO: 20782 - DNA, 547 bp, Homo sapiens
ttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagc

SEQ ID NO: 20783 - DNA, 1536 bp, Homo sapiens
gccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacaggggcaaagaaatgcaagtcaggggaagcctcgaaggtgcctgaaagaaaccttacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttg

SEQ ID NO: 20784 - DNA, 1379 bp, Homo sapiens
aaaaggggaaacggtgcaaacggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttg

SEQ ID NO: 20785 - DNA, 1714 bp, Homo sapiens
atacattttcagttccaaaaaaatttgataacttctgttttgtacctaacttccactactacagtatgtggctctgagccagccaaagattcatgatctgttgactacacagatgtttgcgggctgatcatgcctgcacatctgtagttgggacagttcaaaatttaaaagcagactgcacagatggttctagacgtgctttttgaattgtgtacctttgtaatgttttggggggatatcagaggacagccagaatttgttaccagacttttaaatcgtacaggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaa

SEQ ID NO: 20786 - DNA, 1950 bp, Homo sapiens
cggcgtggccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagcagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagataa

SEQ ID NO: 20787 - DNA, 650 bp, Homo sapiens
ccgccatcttgcttgtgcccccgcttcgcgcgcgctccgttctccgtgacgcacacttccccctcccctccgccgcgcctgggcctctgcattgcccgactccgtaggagcgcgggggcggctcctgctcttcctggactcctgagcagaggatcttgctctgctgttcctgctcaggctggagtgcagtggcgcaatcatggctcactgcaggcttgaccacccaggctcaagcagtcctcccgcctcagcctcttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcag

SEQ ID NO: 20788 - DNA, 1911 bp, Homo sapiens
cgcgcgcgctccgttctccgtgacgcacacttccccctcccctccgccgcgcctgggcctctgcattgcccgactccgtaggagcgcgggggcggctcctgctcttcctggactcctgagcagagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggaggtgcgccagtctgtaactcctgccgagccagtccagtactatttcacgctggctcagcaacccaccgctgtccaagtccagggccagcagcaaggccagcagaccaccagctccacgaccaccatccagcctgggcagatcatcatcgcacagcctcagcagggccagaccacacctgtgacaatgcaggttggagaaggtcagcaggtgcagattgtccaggctcagccacagggtcaagcccaacaggcccagagtggcactggacagaccatgcaggtgatgcagcagatcatcactaacacaggagagatccagcagatcccggtgcagctgaatgccggccagctgcagtatatccgcttagcccagcctgtatcaggcactcaagttgtgcagggacagatccagacacttgccaccaatgctcaacagattacacagacagaggtccagcaaggacagcagcagttcagccagttcacagatggacagctctaccagatccagcaagtcaccatgcctgcgggccaggacctcgcccagcccatgttcatccagtcagccaaccagccctccgacgggcaggccccccaggtgaccggcgactgagggcctgagctggcaaggccaaggacacccaacacaatttttgccatacagccccaggcaatgggcacagccttcctccccagaggacccggccgacctcagcgcctcctgcaggctaggacactggtgcactacaccccatgcctgggggccgagattctccagcagaaagatgcaatattttttgtttcctttttttccatttttttctctaaggaatcaatatttcaatatgttgagtgtgtgtccaatgctatgaaattaaaatattaaataacatatttatggcattttcttgaagagtgtggttgaagaaatatttctccttttgtttttcttttttttttgtttgttactgccacttctttttaggagcaaatctccccaggggtgtacggtatttcttgactctgggaacagctgctacccccaagacttgccacgttgttctgccctcagatggaattaggtgaatgtgtgtagctgctttttcactcgtggtcctctccccatcccttgctctgaccccagagctctgtgtatttgcatccagaggccatggaaacattctttgcatttaagagacagatttattccctgtggagagtgggtggattcattgccacactcttttctcccagggacccaggaaactaggactttgtgtgtttgctgcccacctcccttttattttttaaatgcattaaaaactgtgctagtctcctttgcatggacttcaagctgcatgaaatgcaataaatctcattttagat

SEQ ID NO: 20789 - DNA, 433 bp, Homo sapiens
agttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttccaagagatgaactgaaacctccaaagcgtcaggaggtgcgccagtctgtaactcctgccgagccagtc

SEQ ID NO: 20790 - DNA, 293 bp, Homo sapiens
ttgtcgagatgtccacagaaggaggatttggtggtactagcagcagtgatgcccagcaaagcctacagtcgttctggcctcgggtcatggaagaaatccggaatttaacagtgatgatcagtgcagaagcgcctgtactctttgccaaggcagcccagatttttatcacagagttgactcttcgagcctggattcacacagaagataacaagcgccggactctacagagaaatgatatcgccatggcaattacaaaatttgatcagtttgattttctcatcgatattgttcca

SEQ ID NO: 20791 - DNA, 525 bp, Homo sapiens
ctttttctcttttttcctggtgagaagaacttgtgtccttcaaaagaagattacctttgtctttcgaagtcaggaatttataaaaagagtttgctggatggaaaaatcataaaggccataactctaaaacctaatgtaaagaagaacagttagagctgtccaaagatgggaaagaatgtcttaccagtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatgaaactggatgaagatgtgaagatga

SEQ ID NO: 20792 - DNA, 574 bp, Homo sapiens
atgttgtgctcttgcctggcccgctgctgtcgccgccgccgcgctcgtggggtccgtgtgcctcgtcggcccggcccgcgggctttctcccattggcggaaggcgacggcgggggggctcgctcgtgattggtcggtggcggggaggccgcggacctggcaccttattggacgcgccagctccggtctaggggacacacaaacacaggatactgccagaaactgggcaagaggctgtttgtgaatctcagaaggcacccggtctttgtactccaactaaacctacccatccattagcaagtgtacagagatatcgtcctggcaattgtgcatctttctcctttgaccttagcagtttgcatggcagattgtgccaagatgaggcctgtccagggacccatgcaataaaagttgtcgagatgtccacagaaggaggatttggtggtactagcagcagtgatgcccagcaaagcctacagtcgttctggcctcgggtcatggaagaaatccggaatttaacagtgaaagacttccgagtgcaggaactcccactggctcgtattaagaagattatg

SEQ ID NO: 20793 - DNA, 2692 bp, Homo sapiens
agtcagaggttaacggaaaacggaagctggctggctgagaagaagcttccgttagtcctaccttgaagagaaaagagccagataaagagaaagattaaaagtatgagaaaatacagaagccactggtctcagggagacagagaaggataccaaagaagaagtaactattatgaggggccacacaccagccactcaagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtg

SEQ ID NO: 20794 - DNA, 1085 bp, Homo sapiens
gtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatat

SEQ ID NO: 20795 - DNA, 2562 bp, Homo sapiens
gtggaaaattttgtgcgtttggcgggtttcgctctcttcataagtattgatcattccgcagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctattgcaaaaataaaatctttttataatattatctatgggatgtcagcacaatataacactctgggaagaagtggagttttttggttattaggttaattttctagtaaaacacgttgcctgttttcagttaacactggtaatgccattttaatatatggctttttcaaatcagttcagtgaaaatagtacagatttaggtttacataactactctgacatactggaattgcatatagagatgttcagtggtcgtttttcattttaagtaatttttgttttggcatttttttgtgtgaagtaaattaatcaactagagaggtgcaaaacgttctcagttgatatctgagtattgggtgcatttggtggcttaaaagcaaagcttcctaaaaagatttttcttggcagctccaggtctatacatttaggtaatgaatggtagtagaactaatagctttaacaggagaatagggaatgagaaatagaaatccaaggctgaagccaaaagtaaggagggtggccaaatggtaaactattggtacttgttttctacctcctaaaaatgtagcttatttttaggatttaaatcactaagtaaataagtatccttgccaagtgatcatgagtgtcatttttgttctaagactaatatttttagatctttttacttcacctcatacttatcaccaatgtatatctccatttattcaataacttactggggtaaaataacagcaataaacctaaccttttaacagggtctaacatgagagttggagtcaaagccattgttatcttttggtgacacccttaaattttaagtcttccagtcttccatgtgaactttaggcccaaagtttcttatgtatcacacatcccccaaataagtgattttttcccagtgctttgtactgtcaactgcattatctttaattatttaaaggtagaattatttaattttgtgatttgttcttccatatgacattgagcaaatagatctgtttcaaaatatgttcccgctatgtggataactcttctttttaaaaagaaaatagagaatagcaaatcttcatgataatcctcaaaagaacaaaatgcttaactttatctcttaatttctaaaggtaaataacctaggttcagcttttgcttaaacattaaatatcttttccattttttaatgtttgtaagctagatatgccagctttgtttctacattgcaaccaaaaactgtttcttttcacttaattataaaaccagtaattcatttactcttgcccaaaactatacactgtatttctgttatagtaacaaaatagagttatgtagaattgtatggaactcaaatttaaaccatgctttcttgtagtactgattgaaacttacacgttttattctactcatagtgagcttattcttattttggattgattttccaaaaccacagcttcagcagcaacaatcagaatgtccaaatgctgtcctttcccttacagagaagaacaatggtaactaaaagctgcatataactagcaataactacattgaacggtgtgcattgttcatgattgttgtgttttaagacttgtatataaactgctttttccaaactctgtataacttttaaatggctggaactactcgtataaggactagactgtatttttgacatgctcctatttttgtaacttgaaaaaataaaattttgccttgtgacagat

SEQ ID NO: 20796 - DNA, 937 bp, Homo sapiens
cccaggcttgtcgttagaaaagtaggggactttcctgttgagtatcatgtttacaaaagcaaagtggcttttaaattttaaactaagtatcaaacaagtagataaggtggatgggagggatcttcaggaactgaagggaagtggaacttaagccctgcggaccggacacgtgaggaggtagtgacgccgacactgccagaacacactgctacaaggtcccagatggccacgtctctggattttaaaacttatgtagatcaggcatgtagagctgctgaggagtttgtcaatatttactatgagacaatggataaaagaagacgggcactaaccaggctgtatctggacaaggccaccttaatatggaatggaaatgctgtttcagggctggatgccctaaataatttttttgacacattgccttctagtgagttccaggtcaatatgttagattgccaaccagttcatgagcaagcaactcagtcccaaactacagttcttgttgtgaccagtggaactgtgaagtttgatggaaacaaacaacatttcttcaaccagaacttcctgctgactgctcagtccactcccaacaatactgtgtggaagattgcaagtgattgcttccgttttcaagattggtctagtagttaaaggggcaaaagtccattctcatttggtccattagttccagcaattgaaatttatgtgaattattttgattgtagaagcactataatatgtgctgaaactaaatttctttaatattttctattcctgtcagcaccttttctagcagctgccagtttggagcattgccctctaagagctttaaaactatttttttacatgccttatatacattccactaatgacattcttataataatattaaacacatgatcttggtactaacatactcactgtgaacccagcctat

SEQ ID NO: 20797 - DNA, 4676 bp, Homo sapiens
gaagatggcggcgggggcgaggtgaggtgttggcagtggaaaggggttcgggctcggggggcggggggacgcggagcgatggcccgcgccggccgcaggggcggataaaaagccgtcgcgctgcgggagtgggcgggagggagagggggtgtctgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctccggaagatggaaaagcagatattgtaagagctgctcaggacttttgccagttagtagcccagaagcaaaagagacccacagatttggatgtagatacgttagccagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaacttattataaatggaaagaaagttttatttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacgttgtacgactttttttttttgttttaatttattactgagagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaatttccaaattaaaaacgtatatgtgtactcttttaaaaaggaatttgatagttcttgtcaaatgagaaaatttaaaggtaagagttatggtttgtcttatgctgcatagactattcacctcctaacttgaaggtctaatcataagacaattgtttttttgtgcatagttttcatctaaaattaagtttaccaaaggcaaataactgcttactaggaacttcctttagcaaaaattactataaagttcaggacagtttgaaataaaacccaggaaacaagattaatgtgagcagttctccaagatcctaactggtgggacataaactatgatgcaatggataggaaaaggtagtgcaaaaagaatttcttaaggtttaaaaaatacacttttcattataggaaaaagaagattcagagaaacaaaggaatgtaaccttattgattacatttttggtgatcaccgagaattttttgtactatattttaaaaaatgtattctactgtaacaagttaataaagagattttttaaaaaactataaactagaaa

SEQ ID NO: 20798 - DNA, 3123 bp, Homo sapiens
aatcttccagggtccactgggcaggcctgcaaaataaggcccctagaaactccctgaggttttcaagtcttctccctctcctcggaattttttccccttcattcgcattacttttattctgacggaaacggcgcgggctaggccccaggaggggcgcatttcaggtgcaactggcccggcgatcgcggcgggcaacccctacgaggcccccggttgactaggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 20799 - DNA, 2431 bp, Homo sapiens
aagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggctgagtgcagtggcatgatcacagctcactgcagctttgacttctcaggctcaaatgatcctcctgcctcagcctcacaggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggc

SEQ ID NO: 20800 - DNA, 2289 bp, Homo sapiens
ggaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatg

SEQ ID NO: 20801 - DNA, 2832 bp, Homo sapiens
ctaggagctggcggtccgagctgtggcttggaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactata

SEQ ID NO: 20802 - DNA, 2566 bp, Homo sapiens
agaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttc

SEQ ID NO: 20803 - DNA, 2240 bp, Homo sapiens
agaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctgg

SEQ ID NO: 20804 - DNA, 2567 bp, Homo sapiens
gcggaagttatttttcccccggccggcagggagttgtagttatctttgaaagccttctctctcttttggcataggcgggaaatgtggcgtcaagaggctgggattccgagaaagaagcgaggctttcacgaaaatgcgagcggcttcggcaaggggcggggccgctggacgtggatgaaagctacagagccagcgtggaccaatcagacctctttggggcggggcctctgtggataagtgggcgtggtctaggggggaagtcaccaagaacgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggctggtgtcatgttgggctcctggggcgggggcacggcctggcatttcacgcattgctgccaccccaggtccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 20805 - DNA, 2158 bp, Homo sapiens
cgcaccggaggtccttgcccgccctggaaaacgccctctgcggtgaaggagagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatcccaatgtacaggtggatcatctgaatctcctgaaacagtttgaacacctggaccctcagaaccagcatacattcgaggcccgcgacctggagctgctgatccagacggccacccgggaccttgcccagtacgacgcagcccatcatgaagagttcaagcgctacgagatgcttaaggaacacgagagacggcgttatctggagtcactgggagaggagcagagaaaggaggcggagaggaagctggaagagcaacagcgccggcaccgcgagcaccctaaagtcaacgtgcctggcagccaagcccagttgaaggaggtgtgggaggagctggatggactggaccccaacaggtttaaccccaagaccttcttcatactgcatgatatcaacagtgatggtgtcctggatgagcaggagctggaggcactcttcaccaaggagctggagaaagtgtacgacccaaagaatgaggaggacgacatgcgggagatggaggaggagcgactgcgcatgcgggagcatgtgatgaagaatgtggacaccaaccaggaccgcctcgtgaccctggaggagttcctcgcatccactcagaggaaggagtttggggacaccggggagggctgggagacagtggagatgcaccctgcctacaccgaggaagagctgaggcgctttgaagaggagctggctgcccgggaggcagagctgaatgccaaggcccagcgcctcagccaggagacagaggctctagggcggtcccagggccgcctggaggcccagaagagagagctgcagcaggctgtgctgcacatggagcagcggaagcagcagcagcagcagcagcaaggccacaaggccccggctgcccaccctgaggggcagctcaagttccacccagacacagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccgggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaa

SEQ ID NO: 20806 - DNA, 673 bp, Homo sapiens
gaggtgagaggccagggttcccatactcttgggtcctagggaggatgggggccagagggctggaaaactgggtcccggaggaggatgcactgggtgccagtactttaggtcctgggaaaagaggaggctgggaccctggactcttgggtctgggggaggaggcggccgagatcccggattcctgagtgtgagagaggagcgtgttgggagccaggacccctgggtctgagggcccagactcctgtgtcggaggaagggaaggccggaggcctggaatcctggggcctggaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggctgcggatgctgctcaaggccaagatggacgccgagcaggatc

SEQ ID NO: 20807 - DNA, 563 bp, Homo sapiens
gagcgtgttgggagccaggacccctgggtctgagggcccagactcctgtgtcggaggaagggaaggccggaggcctggaatcctggggcctgggtaacaaaatgcttgtgtcttgattcttggaagtgggggcggcgctgggggcccgaactcctggttccaggggaggaagaggcttgggacagacattatgcattatccagccctccatcccccacagaccacactgccatgcctccctctgggccccgaggaaccctccttctgttgccgctgctgctgctgctcctgcttcgcgccgtgctggctgtccccctggagcgaggggcgcccaacaaggaggagacccctgcgactgagagtcccgacacaggcctgtactaccaccggtacctccaggaggtcatcgatgtactggagacggatgggcatttccgagagaagctgcaggctgccaatgcggaggacatcaagagcgggaagctgagccgagagctggactttgtcagccaccacgtccgcaccaagctggatgagctcaagcgacaggaggtgtcacggct

SEQ ID NO: 20808 - DNA, 1905 bp, Homo sapiens
agcggagcggtgggccgggggctggaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgagtgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacgtgtgtaattttgtttgattatttatttaggaaaataaattattttatcaattgaaatccacatttattacaaatataatttcaaatcattaagatgttatgttattttttgtgtattttttgtggtattagagcaatttagattatagaaaaatgaaaatgcctccaaaagttttatgtagcagcaaattttaagtgctgtatcatttgtataatttgataaccatatttatggtaaaatgatttatttcaactttatttgtaattctttctaattatattaatcttaccagagaatatgttttttaaaattgtgatctatgattagctaagcatattttttaaaacaagtatatttgtatatgaaggaacatttagaataaaggaagatacttttaaaataagaa

SEQ ID NO: 20809 - DNA, 1204 bp, Homo sapiens
atgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgagtgagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaag

SEQ ID NO: 20810 - DNA, 496 bp, Homo sapiens
agtttctcagctgagccaaaggaaatcaagaaatctcctggaatcaaggaaatcaaggaatcaattacttacaccaagctgagcaagagacaacatgaaggcagaggtagcagtaatcagacaggatttccaagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaa

SEQ ID NO: 20811 - DNA, 530 bp, Homo sapiens
ctctcccgaggaatgctgagcaggctctggacgcctctccgtgcacaccccagacctggggaggggagctctccggacaccccagctggccgcccctcgggccctgagtccgaagacccgctaaacagggcccgggcactgaagtaccctattgttctcatcccctctcccgggaccccgcaccctcctccatctaggctgaggttcccagatttgtgtcttggcccctggcggcgccgagattactttgtgattggaagactgaaaggaacagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagt

SEQ ID NO: 20812 - DNA, 2274 bp, Homo sapiens
gaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaagagaaaagaagaagagtctaaatttgaagaaatgaagaaaaagcatgaaaatcaccctaaagttaatcacccaggaagcaaagatcaactaaaagaggtatgggaagagactgatggattggatcctaatgactttgaccccaagacatttttcaaattacatgatgtcaatagtgatggattcctggatgaacaagaattagaagccctatttactaaagagttggagaaagtatatgaccctaaaaatgaagaggatgatatggtagaaatggaagaagaaaggcttagaatgagggaacatgtaatgagtgaggttgatactaacaaagacagattggtgactctggaggagtttttgaaagccacagaaaaaaaagaattcttggagccagatagctgggagacattagatcagcaacagttcttcacagaggaagaactaaaagaatatgaaaatattattgctttacaagaaaatgaacttaagaagaaggcagatgagcttcagaaacaaaaagaagagctacaacgtcagcatgatcaactggaggctcagaagctggaatatcatcaggtcatacagcagatggaacaaaaaaaattacaacaaggaattcctccatcagggccagctggagaattgaagtttgagccacacatttaaagtctgaagtccaccagaacttggaagaaagctgttaactcaacatctatttcatctttttagctcccttcctttttctctgctcaataaatattttaaaagcatatttgaaataaagggagatactttttaaatgaaaacactttttttgggacacagatattaaaggattgaagtttatcagaaccaggaagaaaacaaactcactgtctgctctctgctctcacattcacacggctcttttatttatttttttgttctcctttaatgatttaattaagtggctttatgccataatttagtgaaactattaggaactatttaagtgagaaaactctgcctcttgcttttaaattagattgctctcacttactcgtaaacataggtattcttttatgggtgcttatcattccttctttcaataaatgtctgtttgatattaacaattctggaaaggccacagtatttccctgtgtttcctggtaacgtttttctagttttggcaacctcaactgctagaaattcttcacctgaatcacttttgctaccacttcaggtcatttttcattcttttttattttgctctatactttatcatttaagattaggttatgttacatataacagaaaaaacaaagataacagtggtttaaactaaataggagtttttcttcttacataagtctagaagtaggtggtgtccaggttcctatctttctgctctgctatcctcagtgcatgatttttatcctcagattacctcactctcactgttcaagtttgctcctggag

SEQ ID NO: 20813 - DNA, 937 bp, Homo sapiens
tcccagcgcgagccggaggcgctgggttccctctgctccactcgcagctgggcacccgagctttcttcggggtcgaggagggtggctggctcttggcggggagcaggagaggaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattga

SEQ ID NO: 20814 - DNA, 1837 bp, Homo sapiens
atattattgcaagcctttgcacatctctttgtatcatccccctatgacatcatgtgttaatctcatctcaggactgcaacccaagattgcagtgagtgggaagatacaatttttacagcatcaccaaaaaggataaggttatttggagatggggacttgctatgttgctcaggctggtttcgaactcttggcctcaagtgattttcctgccttggcctctcaaaacacaggaatgcaggtcaaacacattttgagtttctcagctgagccaaaggaaatcaagaaatctcctggaatcaaggaaatcaaggaatcaattacttacaccaagctgagcaagagacaacatgaaggcagaggtagcagtaatcagacaggatttccaagacagggtctcactctgtggcacaatgatcatggttcactgcagcctcggccttctgagctcaagtgatcctcccgcctctgcctccgcctcctgagtagctgggactacagatgtgcgacacagcacctggcaaatttttaagtattttcttcagactgaaacatcattgtgttaaagataaaaaagtaaaaaatattcttgtagagataggatctcactgttgtccagattggtctcaaatttttgagctcaagccatcctcctgccttggcctcccaaagtgctggcattacagggtgaaaaaaactaatcggcaggatgaaacttcgtaaacagcctgtggctccaaaagcttctggaaggctcaagctacccatgtgcatctttgagcctcagtttccccatctttaaaatgaggggtttggaatagatgtctgttctctggggcaggatgcagaggaaagagctgtctgcgaatgggcaagagagaagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaaatttctccttaaaaatatcagtcttggccgggcacggtggctcaggcctgtaatcccagcactttgggaggctgaggcgggcagatcacctgaggtcaggagttcaagaccagcctggccaacatgatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaagaactggatttagtaagtcaccatgtgaggacaaaacttgatgaactgaaaaggcaagaagtaggaaggttaagaatgttaattaaagctaagttggattcccttcaagatataggcatggaccaccaagctcttctaaaacaatttgatcacctaaaccacctgaatcctgacaagtttgaatccacagatttagatatgctaatcaaagcggcaacaagtgatctggaacactatgacaagactcgtcatgaagaatttaaaaaatatgaaatgatgaaggaacatgaaaggagagaatatttaaaaacattgaatgaagaaaa

SEQ ID NO: 20815 - DNA, 463 bp, Homo sapiens
aaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacctctgaaatctgtaagctgtgataaccactcatagaagcttctataatttgccatggcagagatataagtctgactattaactacagaaggaaataatcttcatgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagta

SEQ ID NO: 20816 - DNA, 514 bp, Homo sapiens
ggggcagagcggagcggtgggccgggggctggaggacaggtttgtgcgctggacgcaagcaccaggcgcagcctcgctcgccgagacccggccaggtaaggccggtggccgcgcgaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatttctccttaaaaatatcagtcttggccgggcacggtggctcaggcctgtaatcccagcactttgggaggctgaggcgggcagatcacctgaggtcaggagttcaagaccagcctggccaacatgatgaggtggaggaccatcctgctacagtattgctttctcttgattacatgtttacttactgctcttgaagctgtgcctattgacatagacaagacaaaagtacaaaatattcaccctg

SEQ ID NO: 20817 - DNA, 536 bp, Homo sapiens
agagcggagcggtgggccgggggctggaggacaggtttgtgcgctggacgcaagcaccaggcgcagcctcgctcgccgagacccggccagaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacgtccgtatctctcttatgaaagaagagggtgataaaggaaaggagaaggccattcttactgacctgatagtggaagaaaagtagatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaa

SEQ ID NO: 20818 - DNA, 498 bp, Homo sapiens
actcgcagctgggcacccgagctttcttcggggtcgaggagggtggctggctcttggcggggagcaggagaggaacgtgttacgagtcagtttttagtgaaaaaacattgagctaggagccaagacccatctcttcactattttggtattgtgcaagtcatcttacctctctggatctcagttgtctcatctgtaaaaaggagataaaaattatttacctgcctgaacatgaggtggaggaccatcctgctacagtattgctttctcttgattacatgtttacttactgctcttgaagctgtgcctattgacatagacaagacaaaagtacaaaatattcaccctgtggaaagtgcgaagatagaaccaccagatactggactttattatgatgaatatctcaagcaagtgattgatgtgctggaaacagataaacacttcagagaaaagctccagaaagcagacatagaggaaataaagagtgggaggctaagcaaa

SEQ ID NO: 20819 - DNA, 2274 bp, Homo sapiens
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 20820 - DNA, 2300 bp, Homo sapiens
aagtgtgaaaaaagcgcgcctctgttgggacgggaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcat

SEQ ID NO: 20821 - DNA, 1629 bp, Homo sapiens
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagt

SEQ ID NO: 20822 - DNA, 2232 bp, Homo sapiens
gtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 20823 - DNA, 2256 bp, Homo sapiens
gccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 20824 - DNA, 2409 bp, Homo sapiens
gcgttacaggccctttggcgcctgcgtattcgtgaagtgtgaaaaaagcgcgcctctgttgggacgggaaatcagcctttctattggtcagggttagaaaccccgcctttgaggcattttcaaccaatggaagcgcggcattcttcatttaaactgtctataaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataga

SEQ ID NO: 20825 - DNA, 2790 bp, Homo sapiens
cgcgcggcattctggggccggaagtggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtgatcgtatggagcactggggaagagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccactcgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccctgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggaggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttgaaaatttgttcctttcctttgaagtcacattttcttttaaaattttttgttttgcatccgaaaccgaaagaaataaagcggtgggaggcagggccattgtgttg

SEQ ID NO: 20826 - DNA, 3348 bp, Homo sapiens
atgaaatttagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaaaaggattgagagggaagaagaggaagaagaagaagcccttcctttagatatgatggatgaagatgacttacagttaatgaaggatttaggacaaagagtatcttttctaacaagagatctttcttctagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgc

SEQ ID NO: 20827 - DNA, 3455 bp, Homo sapiens
ggtagtgtagggacttcggcacgtgtgtcattccccgggatttctgtagtaaccctgcttctggtgaacttgtctggccggcattcatttaaggcctaaggatgaaggcgagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaaaaggattgagagggaagaagaggaagaagaagaagcccttcctttagatatgatggatgaagatgacttacagttaatgaaggatttaggacaaagagtatcttttctaacaagagatctttcttctagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttccta

SEQ ID NO: 20828 - DNA, 1715 bp, Homo sapiens
gtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaaggttactacaaaaggctgaatttgaagggagtaaaggtcagttgcagtgaagaaactccctttgttgccttcccgtgagaagtagcttggtgatgagagaaagctgccaccatctggtctggattaagcaaacacccttctcctcaggcccctgccaataaggcaaagcccagagcgaacacatctcaccaggaggaaaagcagaatgtgatggactga

SEQ ID NO: 20829 - DNA, 1632 bp, Homo sapiens
ccggcggctgagaatccgcgttgttccgtgttgggggcggcatggagcgggagccgggcgccgcgggagttcgccgggctctgggccgccggctggaggcggtgctggcgagccgcagtgaggccaacgccgtgttcgacatcctggccgtgctgcagtctgaggaccaggaggagatccaggaagcagtccgcacgtgcagccgtcttttcggggccttgctggagcggggagagctgtttgtgggccagctgccctctgaggagatggtcatgacagggtcccagggagccacacggaagtacaaggtgtggatgagacaccgctatcacagctgctgcaatcgcttgggagagctcctgggccacccctcctttcaggtcaaggagctggccctcagcgcactcctgaagttcgtgcagctggaaggagcgcaccccctggagaagtccaagtgggaaggcaactacctgttcccccgagagctcttcaagttggtggtgggaggcctgctgtctcctgaggaggaccagagcctgctcctgtcccagttccgggagtacctggactacgacgacacccgctaccacaccatgcaggcagccgtggatgccgtggcccgggtcactggccagcaccccgaggtgccccccgccttttggaacaatgccttcacgctgctgtctgccgtgagcctgccccgccgggagcccaccgtctccagcttctatgtgaagcgggcggagctgtgggacacctggaaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggagagctccctgtgggagcttcaggccctccagcgccactaccaccctgaggtgtccaaagccgccagcgtcatcaaccaggccctgtccatgcctgaggtcagcatcgcgccactgctggagctcacggcctacgagatctttgagcgggacctgaagaagaaggggcccgagccggtgccactggagtttatcccagcccagggcctgctgggacggccgggtgaactctgtgcccagcacttcacgctcagctgaccctggcccacctgtgaataaatctcagctgaccccagcc

SEQ ID NO: 20830 - DNA, 646 bp, Homo sapiens
cccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaaggtatgactattctaatttaactaacttctcatgtaagtgtcaagtgcacttgcagatgtttccagtcaaatatgaatggcccttagaaagccagcatgggcctggccaaggttagctggggcctattccctgtatttcatacaaataaaaactgcatccacattggtgtgtagtggatgcttaaagtgaactccagtaaatttcctgatttatttttacgtgaatgctaattagaaaatgtaactctattttttagttaatttgcaaaagaaaaatgaagactgtgaaaaaggaaatgactccaagaaagttaaagtacaaaaagtacagtctgtcaggtaatgagtcttttgtttcatttgggatgtaaaggagacctttaagagagttaaagtattggctaacatgggaaaata

SEQ ID NO: 20831 - DNA, 1184 bp, Homo sapiens
cagaggtcagacggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagcccctggaggaagacgaggaaggggacgatgagtttgacgatgaggccccggaggagctgactttcgccagcgcccaggcggaagcgagagaagaggagcggcgagtgcgggagaccgtgcgcagggataaaacgctcctgaaggagaagaggaagcgacgcgaggagctgttcatcgaacagaagaaaagaaaactccttccagacactattttggagaagttaaccacagcttcacagactaacatcaagaaatcgccaggaaaggtgaaagaagttaatttgcaaaagaaaaatgaagactgtgaaaaaggaaatgactccaagaaagttaaagtacaaaaagtacagtctgtcagccagaataaaagctacttggccgtaaggctaaaagaccaagatctgagagattcaaggcaacaagcagcacaagccttcatacataattcattatatgggccaggaaccaacaggactactgtaaataagttcctgtctcttgccaacaagaggttaccagtgaaaagagctgctgtccagtttttgaataatgcttggggaatccaaaaaaaacaaaatgccaagaggtttaaaagacggtggatggtcagaaagatgaaaactaagaagtaaatcaatgctaaatgaagaatctgtactttgtatgtatagaatttatctaataaatcattcatagatcattttaaaggatcattataaaaatcataaacctatttgaggaagtgctcaaccacatttcattcttctggagtagaactgtgccttgcaatcctagaggaaaaagtggtttaagaaggaattgttttctttttaatatatttaactgaattcaagccatacccacatcagcaacagcacctcttctactctccccgggttagaggggtggcaaaaatggcacggactaaaaggagaaatggatattccagcaaagtctctaactgcagcctgtagacaatttgctattaaagattcagtgcacaaaatata

SEQ ID NO: 20832 - DNA, 4051 bp, Homo sapiens
agaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttg

SEQ ID NO: 20833 - DNA, 4210 bp, Homo sapiens
cttacgccgacctagtccaggaattggtacacacagcgatagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacacttgcgtaacatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagtttt

SEQ ID NO: 20834 - DNA, 1098 bp, Homo sapiens
cttacgccgacctagtccaggaattggtacacacagcgatagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaac

SEQ ID NO: 20835 - DNA, 3136 bp, Homo sapiens
acgtgaccagaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagc

SEQ ID NO: 20836 - DNA, 1396 bp, Homo sapiens
ctccgttgggacacgtgaccagaagttaggggctgcagcggcgctggctttaggtgaacgacgtgattttagaagaactaagggaaagaactcttctctgtatacagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaa

SEQ ID NO: 20837 - DNA, 4281 bp, Homo sapiens
atagtgttcaatagaaactaggggattttggtttaggctcttttgcagtcgttgagggggaggtgacggaggcgtcagggaaggtgggaggacggaaaaggaaattaaaagctcttgggaactgaattgtggtaacggaaccttaggaggctgggttggaaatcgagtaggaaggaagagaggatgctccgttgggacacgtgaccagaagttaggggctgcagcggcgctggctttaggtgaacgacgtgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgtattttccagcctaggctttgtgtgaattataggctatttgaaattttatttctgattatgtcaaatacaccttccattttgtcatttttgtttaaactgataaattacaagtcaacattgagtttta

SEQ ID NO: 20838 - DNA, 551 bp, Homo sapiens
gtggaggggagcgcctctttatttttttcacctacttcctctcttacgccgacctagtccaggaattgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaa

SEQ ID NO: 20839 - DNA, 4343 bp, Homo sapiens
agaagttaggggctgcagcggcgctggctttaggtgaacgacgtggtgaggagtgggtttcgggcatgagaagtcacagggccgtttcctagtctctcttcacttctttgggtcttctcagagaaagaaggctgccgtgggtaggctgggggcggagactatcgggaagaggtaggccgaagttctgcccagaatacacgccatgtggtggacgctggttgggagtctcttctggaaagagtctgtcagctcttggggaagggaagggcgagagctgagcgcctgccgggtgctaaacgaaatgagagatactatgatgggccctagtacctctggaaaagttttcctgagtcccctgtgatacagcaaccttcatagtatagtgttaagaattccaagttctgaaggtagacctgcattataatcctggattcactaattttcgaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatgtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagca

SEQ ID NO: 20840 - DNA, 4053 bp, Homo sapiens
agaagttaggggctgcagcggcgctggctttagaaaattacttttcccactgaaacacacccaagtatatgcccagccttcatgaaagtgaacagagaaacgaagcgcctttatgtgggtggccttagccaggacatttctgaggcagacctacaaaatcagttcagcagatttggagaagtttcggatgtggagatcatcacacggaaagatgaccaaggaaacccacagaaagtttttgcatatatcaacatcagtgtagcagaagcggacctgaaaaaatccatttttcacgttatccagagggacagcagtgatgaagagaattccagtatcgtataactcagcaggtttaggtccattccatttggcatcagcagacatggtagcactttactggtatgtctgttttaaataaaacaaaatggaaaggtggaacattacaaattcaactagcaaaagaaagctttctgcacagattggcccaagagagagaagcagcaaaagctaagaaagaagaatcaacaacaggtaacgccaacttgttagaaaagacaggaggagtggatttccatatgaaagctgtgccagggacagaagtgccagggcataagaattgggttgtgagcaaatttggaagagtcttacctgttcttcaccttaaaaatcaacataaacgtaaaatcatcaaatatgatccctcaaaatactgccacaacctgaagaagataggggaggatttctcaaacaccattcctatatccagcctgacttgggaattagaaggagggaatgaccctatgagtaagaaacggcgaggagagttctctgactttcatggccctcccaagaagataataaaagtgcagaaggatgagagttccactgggtctctggccatgagtacaaggcccaggagggtaatagagagaccacccttaacacagcaacaggctgcacaaaaaagaacttgtgattccattactccttctaaatcatctcctgtacctgtttctgatactcagaaacttaaaaatctaccttttaagacttctggcttggaaactgccaagaagagaaacagcatttctgatgatgatactgattctgaagatgaattgagaatgatgattgcgaaagaggaaaacttacagagaactacacaaccctcaataaatgaatctgaaagtgatccttttgaagttgtaagggatgatttcaaatcaggcgttcacaaactgcattctttaataggtttaggtatcaaaaatcgtgtctcttgccatgatagtgatgatgatattatgagaaatgatcgtgagtatgactcaggagatacagatgaaattattgcgatgaaaaaaaatgttgctaaggtcaaaaacagtacagaattttcacaaatggaaaaatctacgaagaaaacttctttcaaaaatagagaaaactgtgagctttctgatcactgtattaaactacaaaaaagaaaaagcaatgtagagtcagccctcagtcatggattaaagtctcttaatcgtaaatctccctctcactccagtagcagtgaagatgctgattctgcatcagaattagctgactctgaaggaggtgaggagtataatgccatgatgaaaaactgccttcgtgtgaatctcactttagctgatttggaacaattggctggcagtgatctgaaggttccaaatgaagatactaagagtgatggaccagaaaccaccacccaatgcaagtttgacagaggctccaagagccccaagactcccactggcctccgcagaggccgacagtgtattcgtcctgcggagattgtggcttccctgttagaaggagaggagaacacctgtggcaaacagaaaccaaaggaaaacaatttaaagccaaaatttcaggctttcaagggagtaggctgtctatatgaaaaggagtcaatgaaaaaatccttgaaagacagtgttgcctctaacaataaagatcagaattccatgaaacatgaggatcccagtatcatatccatggaagatgggtccccatatgttaatggctcattaggtgaagtgactccatgccaacatgcaaagaaggcgaatggcccaaactatattcagcctcaaaaaagacagaccacttttgaaagccaggatcgcaaggcagtgtcccctagcagttctgaaaagagaagtaagaatcctatttctaggccattagaaggtaagaagtccttaagtcttagtgcaaagactcacaacataggctttgacaaagacagctgccatagtaccacaaagacagaagcttcacaggaagagcggtctgattcaagcggcctcacatctctcaagaaatcaccaaaggtctcatccaaggacactcgggaaatcaaaactgatttctcactttctattagtaattcgtcagatgtgagtgctaaagataagcatgctgaagacaatgagaagcgtttggcagccttggaagcgaggcaaaaagcaaaagaagtgcagaagaagctggtgcataatgctctggcaaatttggatggtcatccagaggataagccaacgcacatcatcttcggttctgacagtgaatgtgaaacagaggagacatcgactcaggagcagagccatccaggagaggaatgggtgaaagagtctatgggtaaaacatcagggaagctgtttgatagcagtgatgatgacgaatctgattctgaagatgacagtaataggttcaaaattaaacctcagtttgagggcagagctggacagaagctcatggatttacagtcgcactttggcaccgatgacagattccgcatggactctcgatttctagaaactgacagtgaagaggaacaggaagaggtaaatgaaaagaaaactgctgaggaagaagagcttgctgaagaaaaaaagaaagccctgaatgttgtacaaagtgttttgcaaatcaacttaagcaattctacaaacagaggatcagtagctgctaagaaatttaaggacatcatacattatgatccaacgaagcaagaccatgccacttacgaaagaaaaagagatgataagccaaaagaaagtaaagcaaaacgaaaaaagaaaagggaggaagctgagaaactacctgaggtgtctaaagaaatgtattataatattgctatggatctgaaagaaatattccaaactacaaaatataccagtgaaaaggaagagggcacaccctggaatgaggactgtggtaaagagaaacctgaggaaatccaggaccctgcagctctgaccagtgacgctgagcagcccagcgggttcacgttctctttttttgattcagacactaaagacataaaggaagagacctacagagttgaaacagtgaaacctggaaagattgtctggcaggaagaccctcgtttacaagacagcagttcagaagaggaagatgttactgaagaaacagatcacagaaactccagtcctggagaagcatcattacttgagaaagagaccactagatttttctttttctctaagaatgatgaacgacttcaaggttctgacttattctggagaggagtaggaagtaatatgagcaggaactcttgggaggccagaacaaccaacctgcgtatggattgtcgaaagaaacataaagacgcaaaaaggaaaatgaaaccaaaataataaatgtcagctggttttgatactgaatgtgaacaaggctcacctaaggaaactgacccagaaaacagttttagctgacaaagaagaaatttcagagtgaaggaattttaaaaatctggctgacggaatatcattctggttgccatctttttctgtggaactcctctgcatttcttcctaagtaattacttcaaaaattaaattcaacttcttataaaggaagaacaagatagtccttgaaaatactttttgtatataatctctttgccctctatcctgagtaactaatggacatcttctcatgcaaggtttatatgaagcctttttaaataaatgagtcaaagcacttgta

SEQ ID NO: 20841 - DNA, 4741 bp, Homo sapiens
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 20842 - DNA, 3125 bp, Homo sapiens
tggacttgggcctggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggtgggacccagcgaaaatgtggcccttctga

SEQ ID NO: 20843 - DNA, 3411 bp, Homo sapiens
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaatttcccccgta

SEQ ID NO: 20844 - DNA, 2190 bp, Homo sapiens
actttttccccagctgagaagtttccttgcggccagccatcatccttcgtgctgcaccctaagtctacatgggaatgggtggttgagcaagtggcagaaggggttctaagatgccctgccctgccaatccacaccagggggtctgagctccatagcctgagagaagcctggggatatgtggctgggccctggattctttgcttactccagccctttagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagaaacagagaaggggatgtgtgcctgggagaggctctgtctccttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 20845 - DNA, 3843 bp, Homo sapiens
ggagttaggcatttccgcccacgtgggaagctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagagctcactgaccaggcatggctcccagctggggttcgagtgcccctccaccaagtgccctatgccgtgaagggctgtttccgcttcctgcccccagcccaggttactgttgtgggcagctaccttctgggcacctgcatccgaccagacatcaatgtggatgtggcactgaccatgcccagggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggatgggacccagcgaaaatgtggcccttctgagtcacatcaccgacactgagcagtggaaaggggctatatgtgtatgaatagaccacattgaaggagcacaatgccctcctgtgttgatgccacttcccagggtggagacagtggaaaagaaccgaggacaggaaaggattgggtaggtgaaggggtcaggggactggtagtcacccaatcttggagaggtgcaaaaagcactgggggctacccgttagctgcatctgccctggctgtttgcccgttcatgtcacaaactgccactactatgtacctgcagtggggttgcagagatgggggagactcaagtcttactccccaggagctcccagggcccaaggaggagaatgctgcctcctttcagtctggtctacacccactttctggtagcctctctgcttcctgtaattctggctgtttttccagactcagctcaaatagtgcccctccttaagcccatccctcgcccccagcctgaggtgatctttccctcctctgaactattagagcagttactgtctgttcagttcgtttggcaggcacacacagtggcataaattctattgttttgaactctgatttaaaattaaattgcagctgggcgtggtggcttatgcttgtaatcccaacacttagggagtcaggagaatcacttgagctcaggagttctagaccaatctgggcaacagagagaccccatctcttttaaataaaaagttaaattgcttaa

SEQ ID NO: 20846 - DNA, 3412 bp, Homo sapiens
agctatgaggtatagacccggctagaatctgaagtgcgggagagtgctggaccctgagtgatggggccggcgccagctggagagcagcttcgcggagcgactggagagccagaggtgatggaaccagccctggaaggcacaggcaaagaggggaagaaagcatcctccaggaagcgtacattggctgaacctccagcgaagggcctcctgcagccagtgaagctcagcagggcagaactgtacaaggagcctaccaatgaggagcttaatcgccttcgggagactgagatcttgttccactccagcttgcttcgtttacaggtagaggagctactaaaggaagtaaggctgtcagagaagaagaaggatcggattgatgccttcctacgggaggtcaaccagcgggttgtgagggtgccctcagtccctgagacagaggaaatcctacaggacaaggacgggctgaaccagcgctacttccgcaagcgtgccctctacctggcccacttggctcaccacctggcccaggaccccctctttggcagtgtttgcttctcctacacaaatggctgccacctgaaaccctcactgttgctgcggccgcgtggaaaggatgagcgcctggtcactgtacgtctgcatccgtgccctccacctgacttcttccgcccgtgccgcttgctgccaaccaagaacaatgtgcgctctgcctggtaccgagggcagagtcctgcaggggatggtagcccagagcctcctaccccccgctataacacatgggtcctgcaagatacagttctcgagtcccatttgcagctgctgtcaaccattctgagttcagcccagggcctgaaggatggcgtggcacttctgaaggtctggctgcggcagcgggagctggacaagggccagggtgggtttactgggttccttgtctccatgctggttgtcttccttgtgtctacacgcaagatccataccaccatgagtggctaccaggtcctgagaagtgtcttgcagtttctggccactacagacctgacagtcaacgggatcagtttatgtctcagctcagatccctctttgccggccctggctgacttccaccaggccttctccgttgtcttcctggattcctcaggccatctcaacctctgtgctgatgtcactgcctctacttaccaccagggatggtcccttctgtggctccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtag

SEQ ID NO: 20847 - DNA, 2757 bp, Homo sapiens
ctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacgacgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccagccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttccagctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagc

SEQ ID NO: 20848 - DNA, 1100 bp, Homo sapiens
ggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 20849 - DNA, 925 bp, Homo sapiens
ctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 20850 - DNA, 1874 bp, Homo sapiens
agtgtgctccccgccccctgccgcggcgcctcgcctcccggctcacctccccaccccacctgcccgctgcggctctccgcgggagatctcaccgttctggagacagggctcgctcgctctcacggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcctcacctgggaactggttagaactacaaattccctcggccccacccagaccgacgccaagggcagctgtggagtggggcgcggcaatgcgccccttaacagccctccaggcttcttagcccgggcttggacagccgccttccggccagaggggatgaggttgcgctgcgctccgggagcgccgatggcgtgactggccccgcgcggagcagcgacagtaaggctgtgtggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggaggtgggtactcgtcctccaggagttgccggtgagcccttgaccgtggcaggtcccctccagccgcgagcgacccctcagtacctgccgatgcctgctggtctctggcatcctccagtcgagggtcagggtcagggagcaaggcctcacgcgggcgccctccttgcagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagg

SEQ ID NO: 20851 - DNA, 1190 bp, Homo sapiens
agggggcgccaggaggcctcggcgggtccgcaattggccgggacagcttctcacgaaaggtcctgggccggcatcatcagcctcacctgggaactggttagaactacaaattccctcggccccacccagaccgacgccaagggcagctgtggagtggggcgcggcaatgcgccccttaacagccctccaggcttcttagcccgggcttggacagccgccttccggccagaggggatgaggttgcgctgcgctccgggagcgccgatggcgtgactggccccgcgcggagcagcgacactgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 20852 - DNA, 1484 bp, Homo sapiens
gtgctcctcagtgtgctccccgccccctgccgcggcgcctcgcctcccggctcacctccccaccccacctgcccgctgcggctctccgcgggagatctcaccgttctggagacagggctcgctcgctctcacggcttcttagcccgggcttggacagccgccttccggccagaggggatgaggttgcgctgcgctccgggagcgccgatggcgtgactggccccgcgcggagcagcgacagtaaggctgtgtggggggagctgggacctaagccgcgcgcacacccctttctctgcgtctggtggaggtgcacagaggcttttgagtcaggcccaagcgcagccaggtgacctccccgcggcctttcaagcctgagctcggtggacagctccctctcccgtgagtcccgctgtcctgtacgcgcccggtcgagccccgggctgcgcaccccgctaggaggtgggtactcgtcctccaggagttgccggtgagcccttgaccgtggcaggtcccctccagccgcgagcgacccctcagtacctgccgatgcctgctggtctctggcatcctccagtcgagggtcagggtcagggagcaaggcctcacgcgggcgccctccttgcagctgcccggccagcccgcttctctgcccggagccatgaatctcagtagcgccagtagcacggaggaaaaggcagtgacgaccgtgctctggggctgcgagctcagtcaggagaggcggacttggaccttcagaccccagctggaggggaagcagagctgcaggctgttgcttcatacgatttgcttgggggagaaagccaaagaggagatgcatcgcgtggagatcctgcccccagcaaaccaggaggacaagaagatgcagccggtcaccattgcctcactccaggcctcagtcctccccatggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagcccc

SEQ ID NO: 20853 - DNA, 877 bp, Homo sapiens
agtttgaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggagcacgtgctggcactaaccatgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttgca

SEQ ID NO: 20854 - DNA, 3653 bp, Homo sapiens
tacttcattcttcccagtaggagaacccagggcctgttccacgcccacagactttggtcaggcaaagcggccgcagggcgtctgggctaaacgcaaccaggaacacattggcaaacttttgcgcctgcgcccaccgggcgtgcacctgtaggctgaagtcgcgcatgcgctagatgggaacgttgtttcttctcccctaccccttttctgtgggtctgttttagggacagactgcttccgggtcgaagggcttgcttccggagagcgggaaggctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttacaaattccagggttgtctctttttcatgtaataagaaaattaaattttctgttctagttttttctgtaatcataagcattctgatattttaaaatcataaagatgatggaaagtagatttatttttaagccaggtacgtaattttttatttatcataaaatttagtatttttgaatattaaaattaagaagatgactataacaagaatttttctaacataacatgctattattattttagttattttgaagacatttctagtttaactttcatttagcaaacttcctatcaaaataagagcatataaagacttagcgtagt

SEQ ID NO: 20855 - DNA, 2650 bp, Homo sapiens
gctaaaacgcggtagctaaactgcagccaactttggttgtgtgtggaaaaggctttagccatggacaggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttttaccccaacaagccgaagcttactaaggcagccagatatttcctgcattcttggaacaggagggaagtcgccccgacttacgcagtcttcagggttctttggaaatctctccatgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgttttt

SEQ ID NO: 20856 - DNA, 3004 bp, Homo sapiens
aagtgccagcatcagattctgagttccctctatgatctgggtactgtgctagccgcctacaacaaagatcagttattcaagatccttcccctcggggaattagttgtgtaatggagacaaccaagcagtgtaaagtggagtggctttggagagatatcatcccctgtaatccgggaggcagaggtgacacggactgcacggaaacagagtgctcagaaaagagttttacttcaggcatctcaagatgaaaattttggtaatactacaccaagaaaccaggttatccctcgaactcctagctcatttcgacagccttgttctttctaccaaccttttgtttatagttaccccaacaagccgaagcttactaaggcagccagatatttcctgcattcttggaacaggagggaagtcgccccgacttacgcagtcttcagggttctttggaaatctctccatggttactaatctggatgacagtaactgggcagctgcattttcatcacagcgttccgggctgttcacaaacacagagccccacagtataacagaagatgtaactatcagtgctgttatgttacgtgaggatgatcctggagaagctgcatccatgagtatgttttctgatttcctgcagtcttttctgaagcactcttcgagtacagtttttgatcttgtggaagagtatgaaaacatctgtggtagtcaggtgaatatactgagtaaaatagtgagtcgagcaacacctggacttcaaaaattttcaaaaacagccagtatgctctggcttcttcaacaggagatggtcacatggaggctgctggcttctttgtatagagacagaatacagtctgcattagaagaggaaagtgtattcgcagttactgctgttaatgccagtgaaaaaacagttgtggaagcgttatttcagagggattcacttgttcgacaaagtcagctggtggtagattggttagagagtattgccaaagatgaaattggagaattttctgataatattgagttttatgcaaaatcagtatattgggaaaatactctgcataccttaaaacaacggcagctgacttcttacgttggaagtgttcgtccgcttgtcactgaattggaccctgatgctcccataagacagaaaatgccccttgatgatctggatagagaagatgaagttagattactcaaatatctctttactctaatccgtgctggaatgacagaagaggcacaacgactctgtaaacgctgtggtcaagcatggagagctgcaacacttgaaggctggaaactgtaccatgaccctaatgttaatggaggaacagaattagaacctgttgaagggaatccatatagacgcatttggaaaataagttgctggagaatggcagaagatgagctttttaatagatacgagagagcaatttatgcagctttaagtgggaatcttaagcagctgcttcctgtctgtgacacctgggaagacacagtttgggcctacttccgggtgatggtggacagtctggtagaacaggagatccagacatcagtagcaactctggatgaaactgaagaactccctagagaatatctgggagcaaactggacgttagaaaaggtttttgaggaacttcaagctactgacaaaaagagagttctggaagagaatcaagaacattatcatatagttcaaaagtttcttatcctgggagacattgatggtttgatggatgagtttagcaaatggctttccaaaagcagaaacaatctacctggacacctgcttcgctttatgactcaccttattttgtttttccgtactctgggactacagaccaaggaggaagtttctattgaagttttaaagacatacatacagcttttaataagagagaaacatacaaatcttatagcattttatacctgtcatttgcctcaagacctagctgttgcccagtatgcattatttttggaaagtgttacagaatttgaacagcgccaccattgcctggagttggctaaagaagcagatttggatgttgcaacaataacaaaaactgtagttgagaatattcgaaagaaagataatggtgaatttagtcatcatgacctggccccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagaacacatcaaatggtcttactgagaaagctttgtctgccaatgttgtgttttctgcttcatacgatattgcacagtactggtcagtatcaggaatgcctacagttagcagatatggtatcctctgagcgccacaaactgtacctggtattttctaaggaagagctaaggaagttgctgcagaagctcagagagtcctctctaatgctcctagaccagggacttgacccattagggtatgaaattcagttatagtttaatctttgtaatctcactaattttcatgataaatgaagtttttaataaaatatacttgttattagt

SEQ ID NO: 20857 - DNA, 4169 bp, Homo sapiens
ctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagt

SEQ ID NO: 20858 - DNA, 779 bp, Homo sapiens
tttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcaggttcacaaagaaacaaaatctggctgagcatggtggctcatgcgtgcagtctca

SEQ ID NO: 20859 - DNA, 3374 bp, Homo sapiens
aacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcataaatgtcaacttttgctgacttattatgagatgaaaaaccaaaggagagtgggcctaactcatgtgagcttgataactgatgaactcattgggagcattttaaacttttctacataaataataaatgagcactaatg

SEQ ID NO: 20860 - DNA, 3957 bp, Homo sapiens
ctcttcccttaggtgtttaagttccgcgcgcaggccaggctgcaacctgacggccagatccctcgctgtcctagtcgctgctccttggagtcatgttcccagccgccccttctccgcggaccccgggtaccgggtcccgaaggggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttctaaaaatggccattgtttatgaaatctgtataagtgtgtccttatacaaattttaggccataaacaagtgtaagtttgtacaatttcataacatgtatagctgagtttttatactttatatgtaggaagctaatataaaatagttatgtaactgtgattttggttttcagttatgtgacttgttttttccacctgaaatgtgtcagttgttgttcctgtactcggtgccctttctttttactctcacgtggtcccaggttctggagttcttgtcctggttctagctgctcacatgtacaaatcacttctaggcctcagtttctgcgactatgaaaattactagattgcactagcttgtctctaaaattgctgtgactccagatactttgcactgaagagaatctagggtgtttgatatctgtttcagttagggctaatgggaaatgtctagtaagataaatgtcaacttttgctgacttattatgagatgaaaaaccaaaggagagtgggcctaactcatgtgagcttgataactgatgaactcattgggagcattttaaacttttctacataaataataaatgagcactaatgaaagta

SEQ ID NO: 20861 - DNA, 3538 bp, Homo sapiens
atcatcgcgcgccatctcttcccttaggtgtttaagttccgcgcgcaggccaggctgcaacctgacggccagatccctcgctgtcctagtcgctgctccttggagtcatgggcccgctggccggactcgggcccggctccacgccccggacggctagcaggaagggtctgcccctggggtctgcagtcagctccccagtgctcttctcgccggtcggccggcgtagctcgctaagctcgcggggaacaccaacacgaatgttcccacaccactccataactgagtctgtgaactatgatgtgaaaacgtttggatcttctcttcctgttaaagtcatggaagccctaacattggctgaagtcgatgaccagctgaccattaacatagatgaaggtggatgggcttgtctggtgtgcaaagagaagctcattatttggaagattgctctgtcacctattactaagttatccgtttgcaaagaacttcagctgccacctagtgatttccactggagtgccgacttagtggctctttcttactcttctccctcaggtgaagcacattctactcaggctgttgctgtcatggttgccaccagagaaggatctatccgctattggccaagccttgctggtgaagatacctacacagaggcttttgtagattcgggaggtgataagacttacagtttcctaacagcagtgcagggaggaagttttattttgtcttcatcaggaagccaactaattcggttgatacctgagagctcaggaaagattcatcagcatatcctgcctcaggggcaaggcatgctttcaggaattggtcgaaaagtttcttctctttttggaattttatctcctagtagtgatctcacactttcaagtgttctctgggatagagagagatcaagcttttatagcctgacgagttcaaacatcagtaaatgggaattagatgattcttcagaaaagcatgcatacagttgggatataaatagagccctgaaggaaaacattaccgatgctatttggggatctgaaagtaactatgaagctattaaagaaggagtcaacattcgatatttggacttgaagcaaaactgtgatgggctggtgattttggcagcagcatggcactcagcagacaatccatgtctcatctattactctctgataacaatagaagataatggttgccaaatgtcagatgcagttactgtagaagtcactcaatataatccaccttttcagtctgaagacctgattttgtgtcagttgacggtcccaaacttttcaaaccagactgcctatctgtataacgaaagtgctgtctatgtgtgctccacaggaactgggaaattttctcttccccaggagaaaattgtctttaatgcacaaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgagagtatgatttttgagaccactacaaagaatgaaactatagcccaggaagataaaatcaagttgctgaaagctgcctttctgcaatactgcagaaaagatttaggtcatgctcaaatggtggttgatgagctcttttcctctcactctgatttggattctgattctgaactagacagggcagttacccaaatcagtgtagacctgatggatgactacccagcatctgacccacggtgggctgagtctgtccctgaggaagcacctgggttcagcaatacgtcactgattatccttcaccagctagaagacaagatgaaagctcactcttttcttatggactttattcatcaagttggcttatttggacgtctaggcagttttccagttagagggacaccgatggccactcgactgttgctctgtgagcatgccgaaaagctgtcagccgccattgttctcaagaaccaccactcccggctttctgaccttgtcaacacagccatattgattgctttgaacaagagggagtatgaaatcccatccaacctgactcctgcagatgtctttttcagggaggtatcccaagtagataccatctgtgagtgcttactggagcatgaggagcaagtcttgagggatgcacctatggattccattgaatgggctgaagtggtgatcaatgtgaacaatattctcaaggatatgctgcaggctgctagtcattatcgccaaaatagaaactctttgtatagaagagaagaatcactagaaaaagaacctgaatatgttccatggacggcaacaagtggtcctggtggcatccgaacggtaataatacgccagcatgagattgtcctgaaggtggcttatccacaggcagacagcaacctccgaaacatcgtgaccgagcagctggtagccctgatcgattgcttcctggatggttatgtttctcagcttaagtctgtggataaatccagtaatcgggaaagatatgacaatctggagatggaatacctacagaaaagatcagatctcttatctcctcttctttcactaggccagtacctgtgggctgcttctctagcagagaaatactgtgactttgatatattggtacaaatgtgtgagcagactgacaaccagagccgactccagcgctacatgacccagtttgctgatcagaatttttcagactttctcttccgttggtatctggagaaaggaaagcgaggcaaattattatctcagcccatttctcagcatggacagttggcaaattttttgcaagctcatgaacatctcagctggttacatgaaattaatagccaagaattagaaaaggctcatgcaacacttctgggtttggcaaatatggaaactcgttactttgcaaagaagaaaacccttcttggcttgagtaaattggctgcattagcttcagacttttcagaggatatgctacaagaaaaaattgaagaaatggctgagcaggagcgctttctactgcatcaggagaccctacctgaacagctgctggcggagaaacagctaaatctcagtgcgatgccagtattgactgcaccacaactcattggtctatatatctgtgaagaaaatagaagagctaatgaatatgatttcaagaaagctttggacttgttggaatatattgatgaggaagaagatataaatataaatgatctaaaactggaaatcctttgcaaagctcttcagagagataactggtccagttctgatggcaaagatgatccaattgaagtatctaaagacagtatatttgtgaagatcttacagaaacttttaaaagatggcattcagctcagtgagtacttaccggaggtgaaagacctgctacaagcggatcagcttggaagcttaaagtccaatccttacttcgagtttgttttgaaagcaaattatgaatattatgttcagggacaaatataactttttct
